(12) United States Patent
Farhadi et al.

(10) Patent No.: US 11,761,008 B2
(45) Date of Patent: Sep. 19, 2023

(54) GAS VESICLE EXPRESSION SYSTEMS, GAS VESICLE CONSTRUCTS AND RELATED GENETIC CIRCUITS, VECTORS, MAMMALIAN CELLS, HOSTS, COMPOSITIONS, METHODS AND SYSTEMS

(71) Applicant: CALIFORNIA INSTITUTE OF TECHNOLOGY, Pasadena, CA (US)

(72) Inventors: Arash Farhadi, Pasadena, CA (US); Gabrielle H Ho, Pasadena, CA (US); Daniel P Sawyer, Pasadena, CA (US); Mikhail Shapiro, Pasadena, CA (US); Robert C. Hurt, Pasadena, CA (US); Mengtong Duan, Pasadena, CA (US)

(73) Assignee: CALIFORNIA INSTITUTE OF TECHNOLOGY, Pasadena, CA (US)

( * ) Notice: Subject to any disclaimer, the term of this patent is extended or adjusted under 35 U.S.C. 154(b) by 145 days.

(21) Appl. No.: 16/736,683

(22) Filed: Jan. 7, 2020

(65) Prior Publication Data

US 2020/0291409 A1    Sep. 17, 2020

Related U.S. Application Data

(60) Provisional application No. 62/895,553, filed on Sep. 4, 2019, provisional application No. 62/789,295, filed on Jan. 7, 2019.

(51) Int. Cl.
*C12N 15/67* (2006.01)
*C07K 14/195* (2006.01)

(52) U.S. Cl.
CPC ............ *C12N 15/67* (2013.01); *C07K 14/195* (2013.01); *C12N 2510/02* (2013.01)

(58) Field of Classification Search
None
See application file for complete search history.

(56) References Cited

U.S. PATENT DOCUMENTS

| | | |
|---|---|---|
| 5,558,092 A | 9/1996 | Unger et al. |
| 5,824,309 A | 10/1998 | Dassarma et al. |
| 7,498,024 B2 | 3/2009 | Fang et al. |
| 9,107,949 B2 | 8/2015 | Ju |
| 10,493,172 B2 | 12/2019 | Lakshmanan et al. |
| 10,955,496 B2 | 3/2021 | Lu et al. |
| 11,118,210 B2 | 9/2021 | Bourdeau et al. |
| 11,446,523 B2 | 9/2022 | Bar-Zion et al. |
| 2002/0115717 A1 | 8/2002 | Gervais et al. |
| 2003/0147812 A1 | 8/2003 | Ueberle |
| 2003/0157025 A1 | 8/2003 | Unger et al. |
| 2004/0204922 A1 | 10/2004 | Beadle et al. |
| 2004/0265393 A1 | 12/2004 | Unger et al. |
| 2005/0058605 A1 | 3/2005 | Schneider et al. |
| 2006/0025683 A1 | 2/2006 | Hoffmann |
| 2006/0058618 A1 | 3/2006 | Nishiura |
| 2006/0216810 A1 | 9/2006 | Ju |
| 2010/0069757 A1 | 3/2010 | Yoshikawa et al. |
| 2010/0239170 A1 | 9/2010 | Asnis |
| 2012/0020878 A1 | 1/2012 | Qi |
| 2014/0288411 A1 | 9/2014 | Shapiro et al. |
| 2014/0288412 A1 | 9/2014 | Schwartz |
| 2014/0288421 A1 | 9/2014 | Shapiro et al. |
| 2016/0220672 A1 | 8/2016 | Chalasani et al. |
| 2018/0028693 A1 | 2/2018 | Lakshmanan et al. |
| 2018/0030501 A1 | 2/2018 | Bourdeau et al. |
| 2018/0038922 A1 | 2/2018 | Lu et al. |
| 2020/0164095 A1 | 5/2020 | Lakshmanan et al. |
| 2020/0237346 A1 | 7/2020 | Sawyer et al. |
| 2020/0306564 A1 | 10/2020 | Bar-Zion et al. |
| 2021/0060185 A1 | 3/2021 | Lakshmanan et al. |
| 2021/0301298 A1 | 9/2021 | Bourdeau et al. |
| 2023/0139561 A1 | 5/2023 | Bar-Zion et al. |

FOREIGN PATENT DOCUMENTS

| | | |
|---|---|---|
| CN | 105232045 A | 1/2016 |
| EP | 3908656 A1 | 11/2021 |
| WO | 2007/014162 A2 | 2/2007 |
| WO | 2012/038950 A1 | 3/2012 |
| WO | 2018/043716 A1 | 3/2018 |
| WO | 2018/069788 A1 | 4/2018 |
| WO | 2020/146367 A1 | 7/2020 |
| WO | 2020/146379 A1 | 7/2020 |
| WO | 2020/198728 A1 | 10/2020 |
| WO | 2021/041934 A1 | 3/2021 |

OTHER PUBLICATIONS

Abdul Rahman, H.S., et al., "Fast and robust three-dimensional best path phase unwrapping algorithm". Applied Optics, 2007. 46(26): p. 6623-6635.
Ahrens, E.T. et al., "Tracking immune cells in vivo using magnetic resonance imaging". Nature Reviews: Immunology, 2013. 13(10): p. 755-763. 19 pages.
Altschul, et al, Gapped BLAST and PSI-BLAST: a new generation of protein database search programs. Nucleic Acids Res., 1997. 25(17): 3389-3402. p. 14.
Archer, E.J., et al., "Engineered *E. coli* that detect and respond to gut inflammation through nitric oxide sensing". ACS synthetic biology, 2012. 1(10): p. 451-457.
Atanasijevic, T., et al., "Calcium-sensitive MRI contrast agents based on superparamagnetic iron oxide nanoparticles and calmodulin". Proceedings of the National Academy of Sciences, 2006. 103(40): p. 14707-14712.
Barrett, T. et al., "MRI of Tumor Angiogenesis", Journal of Magnetic Resonance Imaging 26, pp. 235-249, (2007), 15 pages.
Bar-Zion, A. et al. Acoustically Detonated Biomolecules for Genetically Encodable Inertial Cavitation. bioRxiv 620567 (2019) 11 pages.

(Continued)

*Primary Examiner* — Suzanne M Noakes
(74) *Attorney, Agent, or Firm* — Steinfl + Bruno LLP

(57) ABSTRACT

Provided herein are genetically engineered gas vesicle expression systems (GVES) that are configured to express gas vesicles (GVs) in a mammalian cell, related gas vesicle polynucleotide constructs, gas vesicle reporting genetic circuits, vectors, genetically engineered mammalian cells, non-human mammalian hosts, compositions, methods and systems, which in several embodiments can be used together with contrast-enhanced imaging techniques to detect and report biological events in an imaging target site comprising a mammalian cell and/or organism.

21 Claims, 27 Drawing Sheets

Specification includes a Sequence Listing.

(56) References Cited

OTHER PUBLICATIONS

Beard, P. "Biomedical photoacoustic imaging." *Interface Focus* 1, 602-631 (2011).

Belkaid, Y. et al., "Role of the microbiota in immunity and inflammation". Cell, 2014. 157(1): p. 121-141.

Blanco, E., et al., "Principles of nanoparticle design for overcoming biological barriers to drug delivery". Nature biotechnology, 2015. 33(9): p. 941-951.

Bourdeau, R.W., et al., "Acoustic Reporter Genes for Non-Invasive Imaging of Microorganisms in Mammalian Hosts." Nature 553, 86-90, (Jan. 2018). 19 pages.

Bowen, C.V., et al., Application of the static dephasing regime theory to superparamagnetic iron-oxide loaded cells. Magnetic Resonance in Medicine, 2002. 48(1): p. 52-61.

Braat, H., et al., "A phase I trial with transgenic bacteria expressing interleukin-10 in Crohn's disease". Clinical gastroenterology and hepatology, 2006. 4(6): p. 754-759.

Brock, R., "The uptake of arginine-rich cell-penetrating peptides: putting the puzzle Together". Bioconjugate chemistry, 2014. 25(5): p. 863-868.

Brooks, et al., "On T2-shortening by weakly magnetized particles: The chemical exchange model". Magnetic Resonance in Medicine, 2001. 45(6): p. 1014-1020.

Buchholz, B., et al., "The distribution of the outer gas vesicle protein, GvpC, on the Anabaena gas vesicle, and its ratio to GvpA". Microbiology, 1993. 139(10): p. 2353-2363.

Buchler, et al., "On schemes of combinatorial transcription logic", Proceedings of the National Academy of Sciences, 2003. 100(9): p. 5136-5141.

Burns, P.N., "Harmonic imaging with ultrasound contrast agents". Clin. Radiol., 1996. 51: p. 50-55.

Caldwell et al. "A *Zoogloea* sp. associated with blooms of Anabaena flosaquae" Canadian Journal of Microbiology, NRC Research Press. Aug. 1978. vol. 24, No. 8. pp. 922-931. (Abstract Only) 2 pages.

Calvo, et al, Upstream open reading frames cause widespread reduction of protein expression and are polymorphic among humans. Proc Natl Acad Sci U S A, 2009. 106(18): p. 7507-12.

Caravan, P., et al., "Gadolinium(III) Chelates as MRI Contrast Agents: Structure, Dynamics, and Applications", Chemical Reviews, 1999. 99(9): p. 2293-2352.

Cherin, E., et al., "Acoustic Behavior of Halobacterium salinarum Gas Vesicles in the High-Frequency Range: Experiments and Modeling". Ultrasound in Medicine & Biology, 2017. 43(5): p. 1016-1030. 33 pages.

Choi, J.J., et al., Noninvasive, transcranial and localized opening of the blood-brain barrier using focused ultrasound in mice. Ultrasound in Medicine & Biology, 2007. 33(1): p. 95-104.

Chu, et al., "A bright cyan-excitable orange fluorescent protein facilitates dual-emission microscopy and enhances bioluminescence imaging in vivo". Nat Biotech 34 (7), 760-767 (2016). 29 pages.

Church C. "Frequency , pulse length , and the mechanical index." *Acoustics Research Letters Online*, 6(3), 162-168, 1-8 (2005).

Claesen, J., et al., "Synthetic microbes as drug delivery systems". ACS synthetic biology, 2014. 4(4): p. 358-364.

Cohen, B., et al., "Ferritin as an Endogenous MRI Reporter for Noninvasive Imaging of Gene Expression in C6 Glioma Tumors". Neoplasia, 2005. 7(2): p. 109-117.

Cohen, B., et al., "MRI detection of transcriptional regulation of gene expression in transgenic mice". Nat Med, 2007. 13(4): p. 498-503.

Corrected Notice of Allowability for U.S. Appl. No. 15/613,104, filed Jun. 2, 2017 on behalf of California Institute of Technology dated Sep. 9, 2019 10 pages.

Cosgrove, D., et al., "Clinical Uses of Microbubbles in Diagnosis and Treatment." Med. Biol. Eng. Comput. 47, 813-826, (2009), 14 pages.

Courbet, A., et al., "Detection of pathological biomarkers in human clinical samples via amplifying genetic switches and logic gates". Science translational medicine, 2015. 7(289): p. 289ra83-289ra83. 49 pages Abstract Only.

Coussios, C. et al., "Applications of Acoustics and Cavitation to Noninvasive Therapy and Drug Delivery." *Annu. Rev. Fluid Mech.* (2008) 40, 395-420. 28 pages.

Cunningham, C.H., et al., "Positive contrast magnetic resonance imaging of cells labeled with magnetic nanoparticles". Magnetic Resonance in Medicine, 2005. 53(5): p. 999-1005.

Dang, L. H. et al., "Combination bacteriolytic therapy for the treatment of experimental tumors." *Proc. Natl. Acad. Sci. U. S. A*.98, 26, 15155-60 (2001).

Daniel, C., et al., "Bioluminescence imaging study of spatial and temporal persistence of Lactobacillus plantarum and Lactococcus lactis in living mice". Applied and environmental microbiology, 2013. 79(4): p. 1086-1094.

Daniel, C., et al., "Recombinant lactic acid bacteria as mucosal biotherapeutic agents". Trends in biotechnology, 2011. 29(10): p. 499-508.

Danino, T., et al., "In vivo gene expression dynamics of tumor-targeted bacteria". ACS synthetic biology, 2012. 1(10): p. 465-470.

Danino, T., et al., "Programmable probiotics for detection of cancer in urine". Science translational medicine, 2015. 7(289): p. 289ra84-289ra84. 28 pages.

Dassarma, et al.,"An improved genetic system for bioengineering buoyant gas vesicle nanoparticles from Haloarchaea". BMC Biotechnol. 2013, 13, 112. 10 pgs.

Dassarma, P., et al., "Bioengineering Novel Floating Nanoparticles for Protein and Drug Delivery." Materials Today: Proceedings: Advances in Functional Materials (Conference 2015), 3(2), 206-210, (2016). 8 pages.

Davila, M. L. et al. "Efficacy and Toxicity Management of 19-28z CAR T Cell Therapy in B Cell Acute Lymphoblastic Leukemia". 6(224), *Sci Transl Med* (2014). 23 pages.

Dawson, P.E., et al., "Synthesis of proteins by native chemical ligation". Science, 1994. 266 (5186): p. 776-779.

Del Vecchio, D and Muarray, R.M. "Biomolecular Feedback Systems" bfs-pupss. Jun. 13, 2014. 280 pages.

Derrien, M., et al., "Fate, activity, and impact of ingested bacteria within the human gut microbiota". Trends in microbiology, vol. 23, No. 6, 2015, pp. 354-366.

Din, M.O., et al., "Synchronized cycles of bacterial lysis for in vivo delivery". Nature, 2016. 536(7614): p. 81-85. 18 pages.

Donaldson, G.P., et al., "Gut biogeography of the bacterial microbiota". Nature Reviews Microbiology, vol. 14, 2016, pp. 20-32.

Errico, C., et al., "Ultrafast ultrasound localization microscopy for deep super-resolution vascular imaging". Nature, 2015. 527(7579): p. 499-502. 9 pages.

Evbuomwan, O.M., et al., "CEST and PARACEST Agents for Molecular Imaging, in The Chemistry of Molecular Imaging". 2015, John Wiley & Sons, Inc. p. 225-243.

Farhadi, A., et al., Recombinantly Expressed Gas Vesicles as Nanoscale Contrast Agents for Ultrasound and Hyperpolarized MRI. AIChE J, 2018. 64(8): p. 2927-2933. 20 pages.

Farhadi A. et al., "Ultrasound imaging of gene expression in mammalian cells" Science 365, 1469-1475, Sep. 2019, 43 pages.

Ferrara, K., et al., "Ultrasound Microbubble Contrast Agents: Fundamentals and Application to Gene and Drug Delivery." Annu. Rev. Biomed. Eng. 9, 415-447, (2007). 35 pages.

Final Office Action for U.S. Appl. No. 15/663,635, filed Jul. 28, 2017 on behalf of California Institute of Technology dated Oct. 24, 2019 27 pages.

Fischbach, M.A., et al., "Cell-based therapeutics: the next pillar of medicine". Science translational medicine, 2013. 5(179): p. 179ps7-179ps7. 7 pages.

Fischer, et al., "Average protein density is a molecular-weight-dependent function". Protein Science, 2004. 13(10): p. 2825-2828.

Forbes N. S., et al., "Sparse initial entrapment of systemically injected *Salmonella typhimurium* leads to heterogeneous accumulation within tumors." *Cancer Res*. 63, 5188-5193(2003).

Foster, et al., "Advances in ultrasound biomicroscopy". Ultrasound in medicine & biology 26, 1-27 (2000).

(56) References Cited

OTHER PUBLICATIONS

Foster, F.S., et al., "Principles and applications of ultrasound backscatter microscopy". Ultrasonics, Ferroelectrics and Frequency Control, IEEE Transactions on, 1993. 40(5): p. 608-617.
Foucault, M.-L., et al., "In vivo bioluminescence imaging for the study of intestinal colonization by *Escherichia coli* in mice". Applied and environmental microbiology, 2010. 76(1): p. 264-274.
Genove, G., et al., "A new transgene reporter for in vivo magnetic resonance imaging". Nat Med, 2005. 11(4): p. 450-454.
Gilad, A.A., et al., "Artificial reporter gene providing MRI contrast based on proton exchange". Nat Biotech, 2007. 25(2): p. 217-219.
Gilad, A.A., et al., "Developing MR reporter genes: promises and pitfalls". NMR in Biomedicine, 2007. 20(3): p. 275-290.
Gilad, A.A., et al., "MRI Reporter Genes". Journal of Nuclear Medicine, 2008. 49(12): p. 1905-1908.
Gillis, et al., "On T2-shortening by strongly magnetized spheres: A partial refocusing model". Magnetic Resonance in Medicine, 2002. 47(2): p. 257-263.
Gillis, et al., "Transverse relaxation of solvent protons induced by magnetized spheres: Application to ferritin, erythrocytes, and magnetite". Magnetic Resonance in Medicine, 1987. 5(4): p. 323-345.
Gorbach, S.L., "Chapter 95: Microbiology of the Gastrointestinal Tract", Medical Microbiology, 4th Edition, Editor: Samuel Baron, University of Texas Medical Branch at Galveston, Galveston, TX (1996). 10 pages.
Griffiths, et al., "The homologies of gas vesicle proteins", Journal of General Microbiology (1992), 138, 1243-1250.
Haacke, E.M. et al., "Susceptibility-Weighted Imaging: Technical Aspects and Clinical Applications," Part 1. American Journal of Neuroradiology 30 (1), pp. 19-30, (Jan. 2009), 29 pages.
Hayes, et al., "Complete amino acid sequence of cyanobacterial gas-vesicle protein indicates a 70-residue molecule that corresponds in size to the crystallographic unit cell". Biochemical Journal, 1986. 236(1): p. 31-36.
Hayes, et al., "The gvpA/C cluster of Anabaena flos-aquae has multiple copies of a gene encoding GvpA", Archives of microbiology, 1995. 164(1): p. 50-57.
Hayes, P., et al., "Gas vesicles are strengthened by the outer-surface protein, GvpC". Archives of microbiology, 1992. 157(3): p. 229-234.
Häcker, G. et al., "Activation of the immune system by bacterial CpG-DNA." *Immunology*105, 245-251 (2002).
He, et al., "Biophysical mechanisms of phase contrast in gradient echo MRI". Proceedings of the National Academy of Sciences, 2009. 106(32): p. 13558-13563.
Holland C. et al., "An Improved Theory for the Prediction of Microcavitation Thresholds." vol. 36, No. 2, 204-208 *IEEE* (1989).
Huang, H. et al. "A G-Quadruplex-Containing RNA Activates Flourescence in a GFP-Like Flourophore", Nat Chem Biol., Aug. 2014, 10 (8); 686-691. 22 pages.
Hung, A.H., et al., "Magnetic Barcode Imaging for Contrast Agents." Magnetic Resonance in Medicine, 77(3), 970-978, (2017). 9 pages.
International Search Report for International Application No. PCT/US2020/012557 filed on Jan. 7, 2020 on behalf of California Institute of Technology dated May 1, 2020 5 pages.
International Search Report for International Application No. PCT/US2020/012572 filed on Jan. 7, 2020 on behalf of California Institute of Technology dated May 6, 2020 4 pages.
Jackson, H. J. et al., "Driving Car T-cells forward." *Nat. Rev. Clin. Oncl.* 13 (6), 370-383 (2016). 31 pages.
Jaffer, F.A. et al., "Molecular and Cellular Imaging of Atherosclerosis", Emerging Applications. Journal of the American College of Cardiology, vol. 47, No. 7, pp. 1328-1338, (2006), 11 pages.
Jang, M. J. et al., "NeuroCa: integrated framework for systematic analysis of spatiotemporal neuronal activity patterns from large-scale optical recording data." *Neurophotonics*2(3), 035003 (2015). 16 pages.
Jensen, et al., "NMR relaxation in tissues with weak magnetic inhomogeneities". Magnetic Resonance in Medicine, 2000. 44(1): p. 144-156.
Jolesz, F.A., "MRI-Guided Focused Ultrasound Surgery". Annual Review of Medicine, 2009. 60(1): p. 417-430. 17 pages.
Karlin, et al., "Applications and statistics for multiple high-scoring segments in molecular sequences",. Proceedings of the National Academy of Sciences, 1993. 90(12): p. 5873-5877.
Karlin, et al., "Methods for assessing the statistical significance of molecular sequence features by using general scoring schemes", Proceedings of the National Academy of Sciences, 1990. 87(6): p. 2264-2268.
Kaufmann, B.A., et al., "Molecular Imaging with Targeted Contrast Ultrasound." Current Opinion in Biotechnology 18(1), 11-16, (2007). 6 pages.
Kinsman, et al., "Genes encoding proteins homologous to halobacterial Gvps N, J, K, F & L are located downstream of gvpC in the cyanobacterium Anabaena flos-aquae", DNA Sequence, 1997. 7(2): p. 97-106.
Kinsman, R., et al., "GvpCs with reduced numbers of repeating sequence elements bind to and strengthen cyanobacterial gas vesicles". Molecular microbiology, 1995. 17(1): p. 147-154.
Kislukhin, A.A., et al., "Paramagnetic fluorinated nanoemulsions for sensitive cellular fluorine-19 magnetic resonance imaging". Nat Mater, 2016. 15(6): 662-668. 19 pages.
Klumpp, S., et al., "Bacterial growth: global effects on gene expression, growth feedback and proteome partition". Current opinion in biotechnology, 2014. 28: p. 96-102.
Koehne G. et al., "Serial in vivo imaging of the targeted migration of human HSV-TK-transduced antigen-specific lymphocytes." *Nature Biotechnology* vol. 21, 405-413 (Apr. 2003).
Kotula, J.W., et al., "Programmable bacteria detect and record an environmental signal in the mammalian gut". Proceedings of the National Academy of Sciences, 2014. 111(13): p. 4838-4843.
Kunth, M. et al., "Protein Nanostructures Produce Self-Adjusting Hyperpolarized Magnetic Resonance Imaging Contrast through Physical Gas Partitioning." *ACS Nano* (2018). 12, 10939-10948. doi:10.1021/acsnano.8b04222.
Kwan, J. J. et al. "Ultrasound-Propelled Nanocups for Drug Delivery." *Small Journal*11, No. 39, 5305-5314 (2015).
Lakshmanan, A., et al., "Molecular Engineering of Acoustic Protein Nanostructures". ACS Nano, 2016. 10(8): p. 7314-7322.
Lakshmanan, A., et al., Preparation of biogenic gas vesicle nanostructures for use as contrast agents for ultrasound and MRI. Nat Protoc, 2017. 12(10): p. 2050-2080.
Lecoq, J. et al., "An Infrared Fluorescent Protein for Deeper Imaging", Nat Biotech, vol. 29, No. 8, pp. 715-716 (2011), 2 pages.
Lee, J.-H., et al., "Artificially engineered magnetic nanoparticles for ultra-sensitive molecular imaging", Nat Med, 2007. 13(1): p. 95-99.
Li, et al., "Gas vesicle genes identified in Bacillus megaterium and functional expression in *Escherichia coli*", J Bacteriol, 1998. 180(9): p. 2450-8.
Li, Z. et al., "Comparison of Reporter Gene and Iron Particle Labeling for Tracking Fate of Human Embryonic Stem Cells and Differentiated Endothelial Cells in Living Subjects", Stem Cells 26 (4), pp. 864-873, (2008), 21 pages.
Lu, G.J., et al., Acoustically modulated magnetic resonance imaging of gas-filled protein nanostructures. Nat Mater, 2018. 17(5): p. 456-463. 15 pages.
Mani, V., et al., "GRadient echo Acquisition for Superparamagnetic particles with Positive contrast (GRASP): Sequence Characterization in Membrane and Glass Superparamagnetic Iron Oxide Phantoms at 1.5T and 3T". Magnetic Resonance in Medicine, 2006. 55(1): p. 126-135.
Maresca D, et al ., "Nonlinear X-Wave Ultrasound Imaging of Acoustic Biomolecules" *Phys RevX*vol. 8, (2018). 041002-1 to 041002-12. 12 pages.
Maresca D, et al., "Biomolecular Ultrasound and Sonogenetics" *Annu Rev Chem Biomol Eng* vol. 9, 229-252 (Jun. 2018). 29 pages.
Maresca, D., et al., "Imaging microvasculature with contrast-enhanced ultraharmonic Ultrasound". Ultrasound in medicine & biology, 2014. 40(6): p. 1318-1328.
Maresca, D., et al., "Nonlinear Ultrasound Imaging of Nanoscale Acoustic Biomolecules". Applied Physics Letters, 2017. 110(7), 073704-1 to 073704-5. 6 pages.

(56) References Cited

OTHER PUBLICATIONS

Matsumoto, et al., "T2 relaxation induced by clusters of superparamagnetic nanoparticles: Monte Carlo simulations". Magnetic Resonance Imaging, 2008. 26(7): p. 994-998.
McMahon, M.T., et al., "New "multicolor" polypeptide diamagnetic chemical exchange saturation transfer (DIACEST) contrast agents for MRI". Magnetic Resonance in Medicine, 2008. 60(4): p. 803-812.
Meeker, D., Finite element method magnetics. FEMM, 2015. 4: p. 32. 162 pages.
Milenic D. E. et al., "Antibody-Targeted Radiation Cancer Therapy." *Nature* 3, (2004). 488-498.
Milo, R., et al., "BioNumbers—the database of key numbers in molecular and cell biology". Nucleic Acids Research, 2010. 38(suppl 1): p. D750-D753.
Mowat, A.M., et al., "Regional specialization within the intestinal immune system". Nature Reviews Immunology, vol. 14, 2014, 667-685.
Myers, et al., "Optimal alignments in linear space", Computer applications in the biosciences: CABIOS, 1988. 4(1): p. 11-17.
Natarajan, S, "NS3 protease from flavivirus as a target for designing antiviral inhibitors against dengue virus", Genetics and Molecular Biology, 33, 2, 214-219 (2010).
Needleman, et al., "A general method applicable to the search for similarities in the amino acid sequence of two proteins", Journal of molecular biology, 1970. 48(3): p. 443-453.
Ngamdee et al. "Competition between Burkholderia pseudomallei and B. thailandesis" *BMC Microbiology, BioMed Central*. 2015. vol. 15, No. 56. 15 pages.
Nilsson, B.L., et al., "Chemical synthesis of proteins". Annu. Rev. Biophys. Biomol. Struct., 2005. 34: p. 91-118. 38 pages.
Non-Final Office Action for U.S. Appl. No. 15/663,635, filed Jul. 28, 2017, on behalf of California Institute of Technology, dated Jan. 2, 2019. 29 pages.
Non-Final Office Action for U.S. Appl. No. 15/663,635, filed Jul. 28, 2017 on behalf of California Institute of Technology dated May 29, 2020 24 pages.
Notice of Allowance for U.S. Appl. No. 15/613,104, filed Jun. 2, 2017 on behalf of California Institute of Technology dated Jul. 18, 2019 15 pages.
Ntziachristos, V., et al., "Looking and Listening to Light: the Evolution of Whole-Body Photonic Imaging." Nature Biotechnology, 23(3), 313-320, (2005). 8 pages.
Ntziachristos, V. "Going deeper than microscopy: the optical imaging frontier in biology." *Nature Methods*7 , No. 8, 603-614 (2010).
Pearson, et al., "Improved tools for biological sequence comparison", Proceedings of the National Academy of Sciences, 1988. 85(8): p. 2444-2448.
Perez, J.M., et al., "Magnetic relaxation switches capable of sensing molecular interactions". Nat Biotech, 2002. 20(8): p. 816-820.
Pfeifer, Felicitas. "Distribution, formation and regulation of gas vesicles" *Nature Reviews—Microbiology*, Macmillan Publishers Ltd. Oct. 2012. vol. 10. pp 705-715. 11 pages.
Piraner, D. I. et al. Going Deeper: Biomolecular Tools for Acoustic and Magnetic Imaging and Control of Cellular Function. Biochemistry 56, 5202-5209 (2017).
Puderbach, M. et al. "MR Imaging of the Chest: A Practical Approach at 1.5 T." European Journal of Radiology 64, 345-355, (2007). 13 pages.
Purnick, P.E. and R. Weiss, "The second wave of synthetic biology: from modules to systems." *Nat Rev Mol Cell Biol*, 2009. 10(6): p. 410-22.
Qin et al. "Bacterial abundance and diversity in pond water supplied with different feeds" *Nature—Scientific Reports*, Nature Publishing Group. Oct. 19, 2016. vol. 6, No. 35232. pp. 1-13. 13 pages.
Ramnarine, et al, "Construction and geometric stability of physiological flow rate wall-less stenosis phantoms." *Ultrasound in medicine & biology* 27, No. 2, 245-250 (2001).

Ramsay, J.P., et al., "A quorum-sensing molecule acts as a morphogen controlling gas vesicle organelle biogenesis and adaptive flotation in an enterobacterium." *Proc Natl Acad Sci U S A*, 2011. 108(36): p. 14932-7.
Reits, E.A., et al., "From fixed to FRAP: measuring protein mobility and activity in living cells". Nature cell biology, 2001. 3(6): p. E145-E147.
Restriction Requirement for U.S. Appl. No. 15/613,104, filed Jun. 2, 2017 on behalf of California Institute of Technology, dated Feb. 21, 2019. 9 pages.
Restriction Requirement for U.S. Appl. No. 15/663,600, filed Jul. 28, 2017 on behalf of California Institute of Technology, dated Dec. 27, 2019. 7 pages.
Rodriguez, P.L., et al., "Minimal" Self"peptides that inhibit phagocytic clearance and enhance delivery of nanoparticles". Science, 2013. 339(6122): p. 971-975. 11 pages.
Romero, P.A., et al., "Exploring protein fitness landscapes by directed evolution". Nature Reviews Molecular Cell Biology, 2009. 10(12): p. 866-876. 25 pages.
Rose, A.B., Intron-mediated regulation of gene expression. Curr Top Microbiol Immunol, 2008. 326: p. 277-90.
Round, J.L. et al., "The gut microbiota shapes intestinal immune responses during health and disease". Nature Reviews Immunology, 2009. 9(5): p. 313-323. 11 pages.
Ruoslahti, E., "RGD and other recognition sequences for integrins". Annual review of cell and developmental biology, 1996. 12(1): p. 697-715. 21 pages.
Ryan, R. M. et al. "Bacterial delivery of a novel cytolysin to hypoxic areas of solid tumors." *Gene Ther.* 16, 329-339 (2009).
Santos E. B. et al., "Sensitive in vivo imaging of T cells using a membrane-bound Gaussia princeps luciferase", *Nat Med* vol. 15, No. 3, 338-344 (Mar. 2009).
Savage, D. C. "Microbial ecology of the gastrointestinal tract." *Annual review of microbiology*31, 107-133 (1977).
Schechter, et al, On the active site of proteases. 3. Mapping the active site of papain; specific peptide inhibitors of papain. Biochem Biophys Res Commun., 1968 32(5): p. 898-902.
Schechter, et al, On the size of the active site in proteases. I. Papain. Biochem Biophys Res Commun., 1967. 27(2): p. 157-162.
Schindelin, J., et al., "Fiji: an open-source platform for biological-image analysis". Nat Meth, 2012. 9(7): p. 676-682. 15 pages.
Schneider, C. et al., "NIH Image to ImageJ: 25 years of image analysis." *Nat. Methods*9(7), 671-675 (2012). 12 pages.
Schweser, F., et al., "Quantitative imaging of intrinsic magnetic tissue properties using MRI signal phase: An approach to in vivo brain iron metabolism?", NeuroImage, 2011. 54(4): p. 2789-2807.
Shaner, N.C., et al., "A bright monomeric green fluorescent protein derived from Branchiostoma lanceolatum". Nat Meth, 2013. 10(5): p. 407-409. 8 pages.
Shaner, N.C., et al., "Improved monomeric red, orange and yellow fluorescent proteins derived from *Discosoma* sp. red fluorescent protein". Nature biotechnology, 2004. 22(12): p. 1567-1572.
Shaner, N.C., et al., "Improving the photostability of bright monomeric orange and red fluorescent proteins". Nature methods, 2008. 5(6): p. 545-551. 25 pages.
Shapiro, M.G., et al., "Biogenic gas nanostructures as ultrasonic molecular reporters". Nature nanotechnology, 2014. 9(4): p. 311-316. 16 pages.
Shapiro, M.G., et al., "Directed evolution of a magnetic resonance imaging contrast agent for noninvasive imaging of dopamine". Nat Biotech, 2010. 28(3): p. 264-270. 15 pages.
Shapiro, M.G., et al., "Genetically encoded reporters for hyperpolarized xenon magnetic resonance imaging". Nat Chem, 2014. 6(7): p. 629-34.
Shapiro, M.G., et al., "Protein Nanoparticles Engineered to Sense Kinase Activity in MRI". Journal of the American Chemical Society, 2009. 131(7): p. 2484-2486. 8 pages.
Silva-Rocha, et al., "Mining logic gates in prokaryotic transcriptional regulation networks", FEBS letters, 2008. 582(8): p. 1237-1244.
Simon, G. L. & Gorbach, S. L. Intestinal flora in health and disease. Gastroenterology 86, 174-193 (1984).

(56) References Cited

OTHER PUBLICATIONS

Simon, R.D., "Morphology and Protein Composition of Gas Vesicles from Wild Type and Gas Vacuole Defective Strains of Halobacterium salinarium Strain 5". Microbiology, 1981. 125(1): p. 103-111.
Smith, et al., "Comparison of biosequences", Advances in applied mathematics, 1981. 2(4): p. 482-489.
Smith TF, et al., Identification of common molecular subsequences. J Mol Biol, 1981. 147(1): 195-197. p. 3.
Smith-Bindman, R., et al., "Use of diagnostic imaging studies and associated radiation exposure for patients enrolled in large integrated health care systems", 1996-2010. JAMA, 2012. 307(22): p. 2400-9.
Sprinzak, D., et al., "Reconstruction of genetic circuits". Nature, 2005. 438(7067): p. 443-448.
Sremac, M., et al., "Recombinant Gas Vesicles from *Halobacterium* sp. Displaying SIV Peptides Demonstrate Biotechnology Potential as a Pathogen Peptide Delivery Vehicle", BMC Biotechnology 8(9), (2008). 14 pages.
Srivastava, A.K., et al., "Advances in using MRI probes and sensors for in vivo cell tracking as applied to regenerative medicine". Disease Models and Mechanisms, 2015. 8(4): p. 323-336.
Steidler, L., et al., "Treatment of murine colitis by Lactococcus lactis secreting interleukin-10". Science, 2000. 289(5483): p. 1352-1355.
Stuber, M., et al., "Positive contrast visualization of iron oxide-labeled stem cells using inversion-recovery with ON-resonant water suppression (IRON)". Magnetic Resonance in Medicine, 2007. 58(5): p. 1072-1077.
Szymczak A. L. et al., "Development of 2A peptide-based strategies in the design of multicistronic vectors." *Expert Opin Biol* Th 5 (5), 627-638 (2005).
Tang, J., et al., "SWIM: Susceptibility Mapping as a Means to Visualize Veins and Quantify Oxygen Saturation, in Susceptibility Weighted Imaging in MRI". 2011, John Wiley & Sons, Inc. p. 461-485.
Taratula, et al., "Functionalized 129Xe contrast agents for magnetic resonance imaging". Current Opinion in Chemical Biology, 2010. 14(1): p. 97-104. 14 pages.
Tashiro, et al., "Molecular genetic and physical analysis of gas vesicles in buoyant enterobacteria", Environmental microbiology, 2016. 18(4): p. 1264-1276.
Terreno, E., et al., "Challenges for Molecular Magnetic Resonance Imaging". Chemical Reviews, 2010. 110(5): p. 3019-3042.
Tsien R. Y., "Imagining imaging's future" *Nature Reviews Molecular Cell Biology*, Ss16-Ss21 (Sep. 2003).
Tsien, R. Y. The Green Fluorescent Protein. Annual Review of Biochemistry 67, 509-544 (1998).
Van Keulen, G., et al., "Gas vesicles in actinomycetes: old buoys in novel habitats?", Trends in microbiology, 2005. 13(8): p. 350-354.
Walsby, A. E."Gas Vesicles." *Annu. Rev. Plant Physiol*.26, 427-439 (1975).
Walsby, A. E. "The pressure relationships of gas vacuoles." *Proc. R. Soc. London. Ser. B. Biol. Sci*.178, 301-326 (1971).
Walsby, A.E., "Cyanobacteria: planktonic gas-vacuolate forms", The Prokaryotes, a Handbook on Habitats, Isolation, and Identification of Bacteria, 2013. 1: p. 224-235.
Walsby, A.E., et al., "The gas-permeability coefficient of the cyanobacterial gas vesicle wall". Journal of General Microbiology, 1992. 138: p. 837-845.
Walsby, A.E., Gas vesicles. Microbiol. Rev., 1994. 58(1): p. 94-144.
Walsby, A.E., "Gas-vacuolate bacteria (apart from cyanobacteria)", in The Prokaryotes, 1981, Springer. p. 441-447.
Walsby, et al., "Average thickness of the gas vesicle wall in Anabaena flos-aquae". Journal of Molecular Biology, 1979. 129(2): p. 279-285.
Walsby, et al., "Gas vesicle proteins". Biochem. J. 1989, 264, 313-322.
Wang, et al., "Quantitative susceptibility mapping (QSM): Decoding MRI data for a tissue magnetic biomarker". Magnetic Resonance in Medicine, 2015. 73(1): p. 82-101.
Wang, Y., et al., "The role of microbiome in central nervous system disorders". Brain, behavior, and immunity, 2014. 38: p. 1-12. 28 pages.
Watanabe et al. "Distribution and identification of proteolytic *Bacillus* spp. in paddy field soil under rice cultivation" Canadian Journal of Microbiology, NRC Research Press. Jul. 1993. vol. 39. No. 7. pp 674-680. (Abstract Only) 2 pages.
Weissleder, R., et al., "Ultrasmall superparamagnetic iron oxide: characterization of a new class of contrast agents for MR imaging", Radiology, 1990. 175(2): p. 489-493.
Wells, J.M., et al., "Mucosal delivery of therapeutic and prophylactic molecules using lactic acid bacteria". Nature Reviews Microbiology, 2008. 6(5): p. 349-362.
Woese, C.R., Bacterial evolution. Microbiological reviews, 1987. 51(2): p. 221-271.
Written Opinion for International Application No. PCT/US2020/012572 filed on Jan. 7, 2020 on behalf of California Institute of Technology dated May 6, 2020 6 pages.
Written Opinion for International Application No. PCT/US2020/012557 filed on Jan. 7, 2020 on behalf of California Institute of Technology dated May 1, 2020 6 pages.
Yablonskiy, D.A., et al., "Theory of NMR signal behavior in magnetically inhomogeneous tissues: The static dephasing regime". Magnetic Resonance in Medicine, 1994. 32(6): p. 749-763.
Yi, et al., "Identifying clusters of functionally related genes in genomes", Bioinformatics, 2007. 23(9): p. 1053-1060.
Yurist-Doutsch, S., et al., "Gastrointestinal microbiota-mediated control of enteric pathogens". Annual review of genetics, 2014. 48: p. 361-382.
Zabow, G., et al., "Shape-changing magnetic assemblies as high-sensitivity NMR-readable nanoprobes". Nature, 2015. 520(7545): p. 73-77. 24 pages.
Zakeri, B., et al., "Peptide tag forming a rapid covalent bond to a protein, through engineering a bacterial adhesin". Proc. Natl. Acad. Sci. U. S. A., 2012. 109(12): p. E690-7.
Zhang, H. F. et al., "Imaging of hemoglobin oxygen saturation variations in single vessels in vivo using photoacoustic microscopy." *Appl. Phys. Lett*.90, 5-7, 053901 (2007).
Zhang, S., et al., "PARACEST Agents: Modulating MRI Contrast via Water Proton Exchange". Accounts of Chemical Research, 2003. 36(10): p. 783-790.
Zordan, R.E., et al., "Avoiding the ends: internal epitope tagging of proteins using transposon Tn7". Genetics, 2015. 200(1): p. 47-58. 42 pages.
Zurkiya, O., et al., "Off-resonance saturation as a means of generating contrast with superparamagnetic nanoparticles". Magnetic Resonance in Medicine, 2006. 56(4): p. 726-732.
Non-Final Office Action for U.S. Appl. No. 16/656,417, filed Oct. 17, 2019 on behalf of California Institute of Technology dated Mar. 23, 2021. 20 pages.
Aguilera et al., "Systemic in vivo distribution of activatable cell penetrating peptides is superior to cell penetrating peptides." Integr Biol (Camb). 2009. 1(5-6): p. 371-381. 22 pages.
Baker, T.A. et al., "ClpXP, an ATP-powered unfolding and protein-degradation machine." Biochimica et Biophysica Acta (BBA)—Molecular Cell Research, 2012. 1823(1): p. 15-28. 33 pages.
Blum-Oehler, G., et al., "Development of strain-specific PCR reactions for the detection of the probiotic *Escherichia coli* strain Nissle 1917 in fecal samples." Research in Microbiology, 2002. 154(1): p. 59-66.
Cameron, D.E. and Collins, J.J., "Tunable protein degradation in bacteria." Nature Biotechnology 2014. 32 (12): p. 1276-1281. 19 pages.
Cha-Molstad et al., "Modulation of SQSTM1/p62 activity by N-terminal arginylation of the endoplasmic reticulum chaperone HSPA5/GRP78/BiP." Autophagy, 2016. 12(2): p. 426-428.
Chassin H. et al., "A modular degron library for synthetic circuits in mammalian cells." Nature Communications 2019. 10: 2013. 11 pages.
Datsenko, K.A. et al., "One-step inactivation of chromosomal genes in *Escherichia coli* K-12 using PCR products." Proceedings of the National Academy of Sciences, 2000. 97(12): p. 6640-6645.

(56) References Cited

OTHER PUBLICATIONS

Drag, M. et al., "Emerging principles in protease-based drug discovery." Nature Reviews Drug Discovery 9 (9), 690-701, (2010). 27 pages.

Elowitz, M.B. and S. Leibler, A synthetic oscillatory network of transcriptional regulators. Nature, 2000. 403 (6767): p. 335-338.

Fernandez-Rodriguez, J. et al., "Post-translational control of genetic circuits using Potyvirus proteases." Nucleic Acids Research 44, No. 13, 6493-6502 (2016).

Gao, X.J. et al., "Programmable protein circuits in living cells." Science 361, 1252-1258 (2018). 8 pages.

Gardner, T.S. et al., "Construction of a genetic toggle switch in Escherichia coli." Nature, 2000. 403 (6767): p. 339-342.

Geva-Zatorsky, N., et al., "In vivo imaging and tracking of host-microbiota interactions via metabolic labeling of gut anaerobic bacteria." Nature Medicine, 2015. 21 (9): p. 1091-1100. 27 pages.

Goll, D.E., et al., "The calpain system." Physiological Reviews, 2003. 83 (3): p. 731-801.

Heim, R. et al., "Engineering green fluorescent protein for improved brightness, longer wavelengths and fluorescence resonance energy transfer." Current Biology 6, 178-182 (1996).

International Search Report and Written Opinion for PCT App. No. PCT/US2020/025608 filed on Mar. 29, 2020 on behalf of California Institute of Technology, dated Jul. 17, 2020. 13 Pages.

Khalil, A.S. et al., "Synthetic biology: applications come of age." Nature Reviews Genetics, 2010. 11(5): p. 367-379.

Lakshmanan A. et al., "Acoustic biosensors for ultrasound imaging of enzyme activity" Nature Chemical Biology, Jul. 2020, 988-996. 23 pages.

Lakshmanan A. et al., "Acoustic biosensors for ultrasound imaging of enzyme activity (Supplementary Information)" Nature Chemical Biology, Jul. 2020, 3 pages.

Lin, M.Z. et al., "Genetically encoded indicators of neuronal activity." Nature Neuroscience 19, No. 9, 1142-1153 (2016).

Lopez-Otin, C. et al., "Proteases: multifunctional enzymes in life and disease." Journal of Biological Chemistry 283, No. 45, 30433-7 (2008).

Machtaler, S., et al., "Assessment of inflammation in an acute on chronic model of inflammatory bowel disease with ultrasound molecular imaging." Theranostics, 2015. 5(11): p. 1175-1186.

Mark Welch, J.L., et al., "Spatial organization of a model 15-member human gut microbiota established in gnotobiotic mice." Proceedings of the National Academy of Sciences, 2017. 114(43): p. E9105-E9114.

Mitra, R.D. et al., "Fluorescence resonance energy transfer between blue emitting and red-shifted excitation derivatives of the green fluorescent protein." Gene 173, 13-17 (1996).

Miyawaki, A. et al., "Molecular spies for bioimaging-fluorescent protein-based probes." Molecular Cell 58, 632-643 (2015).

Muradali, D. et al., "US of gastrointestinal tract disease." Radiographics, 2015. 35(1): p. 50-68.

Non-Final Office Action for U.S. Appl. No. 15/663,600, filed Jul. 28, 2017 on behalf of California Institute of Technology, dated Jun. 23, 2020. 26 pages.

Ong, I.L.H. et al., "Recent developments in protease activity assays and sensors." Analyst 142, 1867-1881 (2017).

Ono, Y. et al., "Calpain research for drug discovery: challenges and potential." Nature Reviews Drug Discovery, 2016. 15 (12): p. 854-876. 34 pages.

Ono, Y. et al., "Calpains—an elaborate proteolytic system." Biochimica et Biophysica Acta (BBA)—Proteins and Proteomics, 2012. 1824 (1): p. 224-236.

Palmer, A.E. et al., "Design and application of genetically encoded biosensors." Trends in Biotechnology 29 (3), 144-152 (2011). 18 pages.

Parks, T.D., et al., "Release of proteins and peptides from fusion proteins using a recombinant plant virus proteinase." Analytical Biochemistry, 1994. 216 (2): p. 413-417.

Phan, J., et al., "Structural basis for the substrate specificity of tobacco etch virus protease." Journal of Biological Chemistry, 2002. 277 (52): p. 50564-50572.

Rodriguez, E.A. et al. "The growing and glowing toolbox of fluorescent and photoactive proteins." Trends in Biochemical Sciences 42 (2), 111-129 (2017). 31 pages.

Sauer, R.T. and Baker, T.A., "AAA+ Proteases: ATP-Fueled Machines of Protein Destruction." Annual Review of Biochemistry, 2011. 80: p. 587-612.

Sauer, R.T., et al., "Sculpting the proteome with AAA+ proteases and disassembly machines." Cell, 2004. 119 (1): p. 9-18. 21 pages.

Sonnenborn, U. et al., "The non-pathogenic Escherichia coli strain Nissle 1917—features of a versatile probiotic." Microbial Ecology in Health and Disease, 2009. 21 (3-4):p. 122-158.

Stein, V. et al. "Protease-based synthetic sensing and signal amplification." Proceedings of the National Academy of Sciences 111, No. 45, 15934-15939 (2014).

St-Pierre, F., et al., "One-step cloning and chromosomal integration of DNA." ACS Synthetic Biology, 2013. 2 (9): p. 537-541.

Suzuki, S., et al., "Development of an artificial calcium-dependent transcription factor to detect sustained intracellular calcium elevation." ACS Synthetic Biology, 2014. 3 (10): p. 717-722.

Tigges, M., et al., "A tunable synthetic mammalian oscillator. Nature," 2009. 457 (7227): p. 309-312.

Turk, B., et al., "Protease signaling: the cutting edge." The EMBO Journal 31, 1630-1643 (2012).

Yin, L. et al., "Quantitatively Visualizing Tumor-Related Protease Activity in Vivo Using a Ratiometric Photoacoustic Probe." J. Am. Chem. Soc., 2019. 141 (7): p. 3265-3273.

International Search Report and Written Opinion for PCT App. No. PCT/US2020/048572 filed on Aug. 28, 2020, on behalf of California Institute of Technology, dated Dec. 29, 2020. 11 Pages.

Notice of Allowance for U.S. Appl. No. 15/663,600, filed Jul. 28, 2017 on behalf of California Institute of Technology, dated Dec. 11, 2020. 13 Pages.

Notice of Allowance for U.S. Appl. No. 15/663,635, filed Jul. 28, 2017 on behalf of California Institute of Technology dated Jan. 26, 2021 15 pages.

EPO Communication pursuant to Rules 161(2) and 162 EPC for EP Application No. 20739042 filed on Jul. 14, 2021 on behalf of California Institute of Technology dated Aug. 18, 2021. 3 pages.

Final Office Action for U.S. Appl. No. 16/736,581, filed Jan. 7, 2020 on behalf of California Institute of Technology dated Dec. 13, 2021. 50 pages.

International Preliminary Report on Patentability for International Application No. PCT/US2020/012557 filed on Jan. 7, 2020, on behalf of California Institute of Technology, dated Jul. 22, 2021. 8 Pages.

International Preliminary Report on Patentability for International Application No. PCT/US2020/012572 filed on Jan. 7, 2020, on behalf of California Institute of Technology, dated Jul. 22, 2021. 8 Pages.

International Preliminary Report on Patentability for International PCT Application No. PCT/US2020/025608 filed on Mar. 29, 2020 filed on behalf of California Institute of Technology, dated Sep. 28, 2021. 7 Pages.

Non-Final Office Action for U.S. Appl. No. 16/736,581, filed Jan. 7, 2020, on behalf of California Institute of Technology, dated Aug. 6, 2021. 62 Pages.

Notice of Allowance for U.S. Appl. No. 15/663,635, filed Jul. 28, 2017, on behalf of California Institute of Technology, dated May 27, 2021. 10 pages.

Notice of Allowance for U.S. Appl. No. 16/656,417, filed Oct. 17, 2019, on behalf of California Institute of Technology, dated Dec. 8, 2021. 7 Pages.

Notice of Allowance for U.S. Appl. No. 16/656,417, filed Oct. 17, 2019, on behalf of California Institute of Technology, dated Sep. 3, 2021. 9 Pages.

Extended European Search Report for EP Application No. 20739042.8 filed on Jan. 7, 2020 on behalf of California Institute of Technology dated Sep. 5, 2022. 10 pages.

(56) References Cited

OTHER PUBLICATIONS

International Preliminary Report on Patentability for International Application No. PCT/US2020/048572 filed on Aug. 28, 2020 on behalf of California Institute of Technology dated Mar. 1, 2022. 7 pages.

Non-Final Office Action for U.S. Appl. No. 16/736,581, filed Jan. 7, 2020 on behalf of California Institute of Technology dated May 31, 2022. 51 pages.

Non-Final Office Action for U.S. Appl. No. 16/833,637, filed Mar. 29, 2020 on behalf of California Institute of Technology dated Jan. 25, 2022. 26 pages.

Notice of Allowability for U.S. Appl. No. 16/656,417, filed Oct. 17, 2019, on behalf of California Institute of Technology, dated Sep. 29, 2022. 4 Pages.

Notice of Allowability for U.S. Appl. No. 16/833,637, filed Mar. 29, 2020, on behalf of California Institute of Technology, dated Aug. 17, 2022. 9 Pages.

Notice of Allowability for U.S. Appl. No. 16/833,637, filed Mar. 29, 2020 on behalf of California Institute of Technology dated Jun. 13, 2022. 6 pages.

Notice of Allowance for U.S. Appl. No. 16/656,417, filed Oct. 17, 2019 on behalf of California Institute of Technology dated Jun. 27, 2022. 9 pages.

Notice of Allowance for U.S. Appl. No. 16/656,417, filed Oct. 17, 2019, on behalf of California Institute of Technology, dated Mar. 31, 2022. 19 Pages.

Notice of Allowance for U.S. Appl. No. 16/736,581, filed Jan. 7, 2020, on behalf of California Institute of Technology, dated Sep. 29, 2022. 34 Pages.

Notice of Allowance for U.S. Appl. No. 16/833,637, filed Mar. 29, 2020 on behalf of California Institute of Technology dated May 16, 2022. 12 pages.

Restriction Requirement issued for U.S. Appl. No. 17/006,591, filed Aug. 28, 2020, on behalf of California Institute of Technology, dated Sep. 8, 2022. 12 Pages.

Notice of Allowance for U.S. Appl. No. 16/736,581, filed Jan. 7, 2020 on behalf of California Institute of Technology. dated Jan. 23, 2023. 14 pages.

Aguino, Carmen F. et al; "Single component biohybrid light-emitting diodes using a white-emitting fused protein."ACS Omega (2018) 3, p. 15829-15836.

Cesaratto, Francesca et al; "Engineered tobacco etch virus (TEV) protease active in the secretory pathway of mammalian cells."J. Biotech. (2015) 212, p. 159-166.

Herrmann, Joerg et al; "Ubiquitin and ubiquitin-like proteins in protein regulation."Circulation Research (May 2007) 100, p. 1276-1291.

Lux, Jacques et al; "Thrombin-activatable microbubbles as potential ultrasound contrast agents for the detection of acute thrombosis."ACS Appl. Mater. Interfaces (Nov. 2017) 9(43), p. 37587-37596. 22 pages.

Non-Final Office Action issued for U.S. Appl. No. 17/006,591, filed Aug. 28, 2020, on behalf of California Institute of Technology. dated Apr. 14, 2023. 39 Pages.

Supplemental Notice of Allowability for U.S. Appl. No. 16/736,581, filed Jan. 7, 2020 on behalf of California Institute of Technologydated Feb. 13, 2023 3 pages.

To, Tsz-Leung et al; "Rationally designed flurogenic protease reporter visualizes spatiotemporal dynamics of apoptosis in vivo." PNAS (Mar. 2015) 112(11), p. 3338-3343.

Notice of Allowance for U.S. Appl. No. 16/736,581, filed Jan. 7, 2020 on behalf of California Insitute of Technology dated Jun. 16, 2023. 11 pages.

Notice of Allowance for U.S. Appl. No. 17/816,373, filed Jul. 29, 2022 on behalf of California Institute of Technology, dated Jun. 8, 2023. 13 pages.

Archaea
Halobacterium sp. NRC-1 pNRC200
Halobacterium sp. NRC-1 pNRC100
Halobacterium mediterranei c-vac
Natronobacterium vacuolatum
Methanosarcina barkeri

Cyanobacteria
Anabaena flos-aquae
Nostoc sp. ATCC29413
Pseudoanabaena sp. PCC6901
Microcystis aeruginosa
Trichodesmium erythraeum

Actinomycetes
Streptomyces coelicolor gvp1
Streptomyces coelicolor gvp2
Streptomyces avermitilis gvp1
Streptomyces avermitilis gvp2
Streptomyces avermitilis gvp3
Streptomyces scabies gvp1
Streptomyces scabies gvp2
Streptomyces peucetius gvp1
Streptomyces peucetius gvp2
Streptomyces diversa™ gvp1
Streptomyces diversa™ gvp2
Saccharopolyspora erythraea
Frankia alni
Frankia sp. EAN1pec
Frankia sp. CcI3
Rhodococcus sp. RHA1 gvp1
Rhodococcus sp. RHA1 gvp2
Rhodococcus equi

Other bacteria
Bacillus megaterium
Rhodobacter sphaeroides
Ancylobacter aquaticus

FIG. 6

Ana-gvpA, Ana-gvpC, Ana-gvpN, Ana-gpvJ, Ana-gvpK, Ana-gvpF, Ana-gvpG, Ana-gvpV, Ana-gvpW Ana-gvpA, Ana-gvpN, Ana-gpvJ, Ana-gvpK, Ana-gvpF, Ana-gvpG, Ana-gvpV, Ana-gvpW Ana-gvpA, Ana-gvpN, Ana-gpvJ, Ana-gvpK, Ana-gvpF, Ana-gvpG, Ana-gvpW A    BURST Ultrasound Imaging
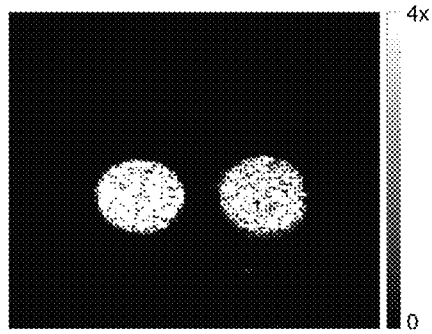
For panels A and B, sample on the left:
Ana-gvpA, Ana-gvpC, Ana-gvpN, Ana-gpvJ,
Ana-gvpK, Ana-gvpF, Ana-gvpG, Ana-gvpV, Ana-gvpW
and right:
Ana-gvpA, Ana-gvpN, Ana-gpvJ, Ana-gvpK,
Ana-gvpF, Ana-gvpG, Ana-gvpV, Ana-gvpW
B    Amplitude Modulation Ultrasound Imaging
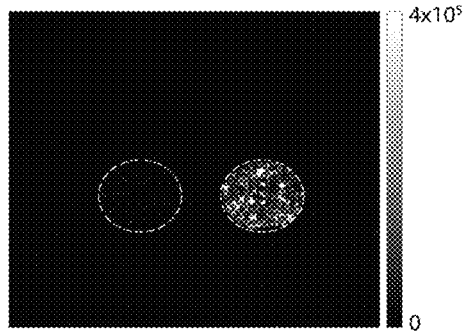
FIG. 27

GAS VESICLE EXPRESSION SYSTEMS, GAS VESICLE CONSTRUCTS AND RELATED GENETIC CIRCUITS, VECTORS, MAMMALIAN CELLS, HOSTS, COMPOSITIONS, METHODS AND SYSTEMS

CROSS REFERENCE TO RELATED APPLICATIONS

The present application claims priority to U.S. Provisional Application No. 62/789,295, entitled "Mammalian Expression Of Gas Vesicles As Acoustic Reporter Genes" filed on Jan. 7, 2019, and to U.S. Provisional Application No. 62/895,553, entitled "Burst Ultrasound Reconstruction With Signal Templates" filed on Sep. 4, 2019, both of which are incorporated herein by reference in its entirety. The present application is also related to U.S. application Ser. No. 16/736,581 entitled "BURST Ultrasound Reconstruction with Signal Templates and related Methods and Systems" filed on Jan. 7, 2020 and PCT Application Number PCT/US2020/012557 entitled "BURST Ultrasound Reconstruction with Signal Templates and related Methods and Systems" filed on Jan. 7, 2020, the content of each of which is also incorporated by reference in its entirety.

STATEMENT OF GOVERNMENT GRANT

This invention was made with government support under Grant No. EB018975 awarded by the National Institutes of Health. The government has certain rights in the invention.

FIELD

The present disclosure relates to gas-filled structures, and in particular genetically engineered gas vesicle gene expression systems, engineered gas vesicle polynucleotide construct and related genetic circuits, vectors, mammalian cells, hosts, compositions, methods and systems and in particular related methods and systems to produce gas filled structures and/or to image biological events in a target site.

BACKGROUND

Reporting biological events, such as a gene expression, proteolysis, biochemical reactions as well as cell location and function, is currently primarily based on fluorescent reporter genes.

Challenges remain for identifying, producing and/or developing biocompatible reporters that can be imaged in deep tissues, enable multiplexed imaging of biological events, are genetically modifiable, are capable of enabling detection at nanomolar concentrations and/or produce dynamic contrast in response to local molecular signals.

SUMMARY

Provided herein are genetically engineered gas vesicle expression systems (GVES) that are configured to express gas vesicles (GVs) in a mammalian cell. Provided herein are also related genetic circuits, vectors, genetically engineered mammalian cells, compositions, methods and systems, which in several embodiments can be used together with ultrasound and/or contrast-enhanced imaging techniques to detect and report biological events in an imaging target site comprising a mammalian cell and/or organism.

According to a first aspect, a genetically engineered Gas Vesicle Expression System (GVES) is described, configured for expressing in a mammalian cell, a gene cluster of gvp genes (GVGC) encoding GV proteins capable of forming a GV type. The Gas Vesicle expression system comprises:

a gvpA/B gene expression cassette comprising a gvpA/B gene under control of a mammalian promoter and additional mammalian regulatory regions in a configuration allowing expression of a gvpA/B protein in the mammalian cell; and one or more additional gvp gene expression cassettes comprising the gvp genes of the GV gene cluster other than gvpB, under control of a mammalian promoter and additional regulatory regions in a configuration allowing expression of the GV proteins other than the gvpA/B in the mammalian cell.

In the Gas Vesicle expression system, each of the one or more additional gvp gene expression cassette, when comprising two or more gvp genes, further comprises a separation element between the two or more gvp genes configured to provide a separate expression of the corresponding GV protein;

In the Gas Vesicle expression system, the GVPB cassette and the one or more additional GVP cassettes are operably linked by regulatory sequences allowing co-expression of the GV proteins and formation of the GV type in the mammalian cell.

According to a second aspect, a Gas Vesicle Polynucleotide Construct (GVPC) is described, comprising
a single gvp gene cassette comprising
two or more gvp genes other than gvpA/B, of a GV gene cluster encoding GV proteins configured to form a GV type,
a separation elements located between the two or more gvp genes; and
a mammalian promoter; and
additional mammalian regulatory regions;
wherein the two or more gvp genes are under control of the mammalian promoter and the additional mammalian regulatory regions in a configuration allowing expression of GV proteins encoded by the two or more gvp genes in the mammalian cell and formation of the GV type in combination with a gvpA/B protein in the mammalian cell.

According to a third aspect, a genetically engineered mammalian Gas Vesicle Reporting molecular component (GVRMC) is described. The gas vesicle reporting molecular component comprises
at least one of the Gas Vesicle expression system (GVES) and the Gas Vesicle polynucleotide construct (GVPC) herein described in which the mammalian regulatory regions comprise a gas vesicle reporting (GVR) target region configured to be activated and/or inhibited by a molecular component of a genetic circuit;
wherein the gvp genes and mammalian regulatory regions are in a configuration allowing expression of GV proteins encoded by the gvp genes through activation and/or inhibition of the gas vesicle reporting (GVR) target region, when the genetic circuit operates according to the circuit design in the mammalian cell.

According to a fourth aspect, a genetically engineered gas vesicle reporting (GVR) genetic circuit (GVRGC) configured for expression in a mammalian cell is described. In the GVR genetic circuit molecular components are connected one to another in a mammalian cell in accordance with a circuit design by activating, inhibiting, binding or converting reactions to form a fully connected network of interacting components.

The GVR genetic circuit comprises a mammalian Gas Vesicle Reporting Molecular Component (GVRMC) herein described in a configuration in which GV proteins encoded by the gvp genes of the GVRMC are expressed and a gas vesicle (GV) type is provided when the genetic circuit operates according to the circuit design.

According to a fifth aspect, a method to express a Gas Vesicles in a mammalian cell is described. The method comprises introducing into the mammalian cell a genetically engineered Gas Vesicle expression system (GVES) herein described for a time and under condition to allow expression of GV proteins encoded by the gvp genes of the GVES and production of the Gas vesicle type in the mammalian cell.

According to a sixth aspect, a genetically engineered mammalian cell is described comprising the Gas Vesicle expression system (GVES) and/or Gas Vesicle Polynucleotide Construct (GVPC) herein described, configured for expression in the genetically engineered mammalian cell.

According to a seventh aspect, a method to provide a gas vesicle in a mammalian host is described. The method comprises introducing into a cell of the mammalian host the genetically engineered Gas Vesicle expression system (GVES), the introducing performed for a time and under condition to allow expression of the GV proteins encoded by the gvp genes of the GVES and the production of the Gas Vesicle type in the mammalian cell.

According to an eighth aspect, a genetically engineered non-human mammalian host is described comprising the Gas Vesicle expression system (GVES) and/or Gas Vesicle Polynucleotide Construct (GVPC) herein described, configured for expression in a mammalian cell of the GV proteins encoded by the gvp genes of the GVES and the production of the Gas Vesicle type in the genetically engineered non-human mammalian host.

According to a ninth aspect, a method and system to provide a genetically engineered a mammalian cell comprising a GVR genetic circuit is described, the method comprising:
  genetically engineering the mammalian cell to introduce into the mammalian cell one or more genetically engineered Gas Vesicle Reporting Molecular Components (GVRMC) herein described wherein at least one of the gvpB gene expression cassette and one or more additional gvp gene expression cassettes comprise a gas vesicle reporting (GVR) target region configured to be activated and/or inhibited by a molecular component of the GVR genetic circuit, to provide a Gas Vesicle Reporting Genetic Circuit (GVRGC) herein described.

According to a tenth aspect, a method is described to image a biochemical event in a mammalian cell comprised in an imaging target site, the method comprising:
  introducing into the mammalian cell a Gas Vesicle Reporting Molecular Components (GVRMC) herein described to provide a GVR genetic circuit in which expression of GV proteins encoded by the gvp genes of the GVRMC and production of the GV type or an intracellular spatial translocation of the GV type occurs when the GVR genetic circuit operates according to the circuit design in response to the biochemical event,
  the introducing performed for a time and under conditions allowing expression of the GV proteins and production of the GV type or an intracellular spatial translocation of the GV type in response to the biochemical event; and
  imaging the target site comprising the mammalian host by applying a magnetic field and/or ultrasound to obtain an MRI and/or an ultrasound image of the target site.
The system comprises the genetically engineered Gas Vesicle expression system (GVES), Gas Vesicle Polynucleotide Construct (GVPC), Gas Vesicle Reporting Molecular Components (GVRMC) and/or GVR genetic circuits (GVRGC), related components and/or mammalian host cells in a combination for simultaneous combined or sequential use in the imaging methods herein described.

According to an eleventh aspect, a method is described to label a target mammalian host, the method comprising:
  introducing into the mammalian cell a Gas Vesicle Reporting Molecular Components (GVRMC) herein described to provide a GVR genetic circuit in which expression of GV proteins encoded by the gvp genes of the GVRMC and production of the GV type or an intracellular spatial translocation of the GV type occurs when the GVR genetic circuit operates according to the circuit design in response to a trigger molecular component;
In the method, the introducing is performed under conditions resulting in presence of the trigger molecular component in the target mammalian host.

In some embodiments, the method can further comprise imaging the target site comprising the target mammalian host, by applying a magnetic field and/or ultrasound to obtain an MRI and/or an ultrasound image of the target site. The system comprises the genetically engineered GVES, GVPC, related polynucleotide constructs, GVR genetic circuits, related components and/or mammalian host cells in a combination for simultaneous combined or sequential use in the imaging methods herein described.

According to a twelfth aspect, a composition is described. The composition comprises a genetically engineered Gas Vesicle expression system (GVES), Gas Vesicle Polynucleotide Construct (GVPC), Gas Vesicle Reporting Molecular Components (GVRMC) and/or GVR genetic circuits (GVRGC) of the disclosure, vectors, and/or genetically engineered mammalian cells described herein together with a suitable vehicle.

The Gas Vesicle expression system (GVES), Gas Vesicle Polynucleotide Construct (GVPC), Gas Vesicle Reporting Molecular Components (GVRMC) GVR genetic circuits (GVRGC), related vectors, genetically engineered mammalian cells, compositions, methods and systems can be used in several embodiments for reporting biochemical events in a mammalian cell in vitro, or in vivo, and in particular can be used for non-invasive reporting of biochemical events in mammalian cells using contrast-enhanced imaging techniques such as MRI and/or ultrasound, two widely available techniques with high resolution and deep tissue penetration.

In particular, in several embodiments described herein, the Gas Vesicle expression system (GVES), Gas Vesicle Polynucleotide Construct (GVPC), Gas Vesicle Reporting Molecular Components (GVRMC) GVR genetic circuits (GVRGC), related vectors, genetically engineered mammalian cells, compositions, methods and systems can be used to report the location of mammalian cells configured to express one or more GV types within an imaging target site, and/or sense and report one or more biochemical events in a mammalian cell configured to express one or more GV types within an imaging target site.

The GVES, and related GV polynucleotide constructs, GV reporting molecular components, GVR genetic circuits, vectors, genetically engineered mammalian cells, genetically engineered non-human mammals, compositions, methods and systems herein described, can be used in several embodiments to allow multiplexed imaging of a mammalian cell using parametric MRI, and differential acoustic sensitivity and background-free MRI when combined with ultrasound detection.

The GVES, and related GV polynucleotide constructs, GV reporting molecular components, GVR genetic circuits, vectors, genetically engineered mammalian cells, genetically engineered non-human mammals, compositions, methods and systems herein described, can be used in several embodiments to detect events such as multiple gene expression, proteolysis and/or biochemical reactions by clustering-induced changes in MRI contrast also enable the design of dynamic molecular sensors.

The GVES, and related GV polynucleotide constructs, GV reporting molecular components, GVR genetic circuits, vectors, genetically engineered mammalian cells, genetically engineered non-human mammals, compositions, methods and systems herein described, can be used in several embodiments to report biochemical events in mammalian cells and/or host through multiplexing, multimodal MRI and/or ultrasound detection.

The GVES, and related GV polynucleotide constructs, GV reporting molecular components, GVR genetic circuits, vectors, genetically engineered mammalian cells, genetically engineered non-human mammals, compositions, methods and systems herein described, can be used in several embodiments to produce dynamic contrast in response to local molecular signals in mammalian cells and/or host The GVES, and related GV polynucleotide constructs, GV reporting molecular components, GVR genetic circuits, vectors, genetically engineered mammalian cells, genetically engineered non-human mammals, compositions, methods and systems herein described, can be used in several embodiments to provide ultrasound imaging of mammalian cells lowing for sensitive and selective ultrasound imaging in order to detect gas vesicle-expressing cells at volumetric concentrations below 0.5% in vitro, and/or to image gene expression in mammals in vivo using ultrasound.

The GVES, and related GV polynucleotide constructs, GV reporting molecular components, GVR genetic circuits, vectors, genetically engineered mammalian cells, genetically engineered non-human mammals, compositions, methods and systems herein described, can be used in several embodiments to track movement of mammalian cells in target sites of interest such as mammalian tumor cells, immune cells, red blood cells, and stem cells within the body of an individual or other environments.

The GVES, and related GV polynucleotide constructs, GV reporting molecular components, GVR genetic circuits, vectors, genetically engineered mammalian cells, genetically engineered non-human mammals, compositions, methods and systems herein described, can in some embodiments be used to allow measures of fluid flows within blood and lymphatic circulation systems by detecting the spatial location of the ultrasound contrast produced the by the cells in an image and tracking the spatial changes of that contrast over time as well as measuring movement of cells inside a tissue as will be understood by a skilled person.

The GVES, and related GV polynucleotide constructs, GV reporting molecular components, GVR genetic circuits, vectors, genetically engineered mammalian cells, genetically engineered non-human mammals, compositions, methods and systems herein described can be used in connection with various applications wherein reporting of biological events, labeling of mammalian cells, and/or tracking of their movement in a target site is desired.

For example, the GVES, and related GV polynucleotide constructs, GV reporting molecular components, GVR genetic circuits, vectors, genetically engineered mammalian cells, genetically engineered non-human mammals, compositions, methods and systems herein described, can be used for visualization of biological events, such as a gene expression, proteolysis, biochemical reactions, such as production of signaling molecule and ion concentration changes, as well as cell location on a target site (e.g. tumor cells inside a host individual, such as mammalian hosts).

The GVES, and related GV polynucleotide constructs, GV reporting molecular components, GVR genetic circuits, vectors, genetically engineered mammalian cells, genetically engineered non-human mammals, compositions, methods and systems herein described, can also be used in developmental biology, the development and monitoring of diagnostic and therapeutic cellular agents and/or of genetic therapeutic circuits (for example to correct or modify genetic disorders) in medical applications, as well diagnostics applications, such as monitoring of therapeutic cell/agent efficacy and safety during developmental stages and clinical usage.

Additional exemplary applications include uses of the GVES, and related polynucleotide constructs, GVR genetic circuits, vectors, genetically engineered mammalian cells, genetically engineered non-human mammals, compositions, methods and systems herein described in several fields including basic biology research, applied biology, bio-engineering, bio-energy, medical research, medical diagnostics, therapeutics, and in additional fields identifiable by a skilled person upon reading of the present disclosure.

The details of one or more embodiments of the disclosure are set forth in the accompanying drawings and the description below. Other features, objects, and advantages will be apparent from the description and drawings, and from the claims.

BRIEF DESCRIPTION OF THE DRAWINGS

The accompanying drawings, which are incorporated into and constitute a part of this specification, illustrate one or more embodiments of the present disclosure and, together with the detailed description and the examples, serve to explain the principles and implementations of the disclosure.

FIG. 6 shows diagrams illustrating organization of exemplary gvp gene clusters, wherein each letter indicates a gvp gene, and an arrow beneath a group of letters indicates an operon, with the direction of the arrow indicating the direction of transcription. [2]

FIG. 7 bottom panel shows representative whole cell TEM images of *E. coli* Rosetta 2(DE3)pLysS cells after expression of gas vesicles genes for 22 hours. Scale bars represent 500 nm. Expression performed as in Farhadi et al. 2018 (21) and TEM imaging as in Bourdeau et al. *Nature,* 2018 (13). The results indicate that gvpR and gvpT genes in the *B. megaterium* gene cluster are not necessary for gas vesicle formation.

FIG. 9A shows a schematic representation of the experimental approach. FIG. 9B shows a chart reporting a qualitative estimate of the relative number of gas vesicles produced when each indicated gene was supplied solely by the polycistronic plasmid. FIG. 9C shows representative TEM images of gas vesicles in the lysate of HEK293T cells for all 8 assays. Scale bars represent 500 nm.

FIG. 10A shows a schematic representation of a genetic construct including exemplary regulatory regions usable in polynucleotide constructs of the present disclosure. FIG. 10B shows a diagram reporting FACS of mCherry cells, with selected cells indicated with dark gray dots.

FIG. 11 Panel A shows a schematic representation of the integrating constructs used to generate polyclonal cell lines. FIG. 11 Panel B shows a chart illustrating FACS of mARG-expressing HEK293-tetON cells. The cells are sorted for each group (subtype 1, subtype 2, subtype, 3, subtype 4) as indicated with the remaining smaller gray dots indicating unsorted population. FIG. 11 Panel C shows a chart illustrating the relative fluorescence of the four polyclonal subtypes sorted. Dark gray bars indicate mCherry expression; light gray bars indicate EmGFP and eBFP2 expression. FIG. 11 Panel D shows a chart reporting the approximate gas vesicle yield from polyclonal cells in each subtype. FIG. 11 Panel E shows a chart reporting FACS of mARG-expressing CHO-tetON cells. Dark gray data indicate cells sorted in subtype 1 and small light gray dots are unsorted cells. FIG. 11 Panel F shows representative TEM image of buoyancy-enriched lysate from CHO-tetON cells sorted as indicated in FIG. 11 Panel E. Scale bar represents 500 nm. FIG. 11 Panel G shows a chart reporting the approximate gas vesicle yield for the sorted mARG-expressing CHO-tetON cells.

FIG. 12 Panel B shows a schematic representation of nine expression cassettes comprising genes from *B. megaterium* capable of encoding gas vesicle expression in mammalian cells. Thin arrow denotes CMV promoter. polyA denotes SV40 polyadenylation element. FIG. 12 Panel C shows Representative TEM image of purified gas vesicles expressed in HEK293T cells. FIG. 12 Panel D shows a schematic representation of gene cassettes comprising the mammalian acoustic reporter gene construct, mARG. FIG. 12 Panel E shows representative TEM image of gas vesicles purified from HEK293T cells transiently transfected with mARGs for 72 hours. All scale bars represent 500 nm.

FIG. 13 Panel A show a schematic representation of mARG constructs used for genomic integration into cells with the piggyBac transposase system. ITR, inverted terminal repeat; ChβGI, Chicken beta-globin insulator; GFP, Emerald green fluorescent protein; BFP, enhanced blue fluorescent protein 2. FIG. 13 Panel B shows representative TEM image of buoyancy-enriched lysate from HEK293-tetON cells transfected with the constructs in FIG. 13 Panel A and sorted for high expression of all three operons. FIG. 13 Panel C shows fluorescence-activated cell sorting of HEK293-tetON cells transfected with the constructs in FIG. 13 Panel A. Large gray circles denote individual cells selected by sorting to form monoclonal cell lines. FIG. 13 Panel D shows a flowchart illustrating a selection process for monoclonal cell lines, including assays for viability, fluorescence intensity and gas vesicle yield. FIG. 13 Panel E shows a chart illustrating the number of gas vesicles expressed by monoclonal HEK293-tetON cells after 72 hours of induced expression, as counted in lysates using TEM. Bar represents the mean and the shaded area represents SEM (n=3, each from two technical replicates). FIG. 13 Panel F shows Representative TEM image of a 60-nm section through an mARG-HEK cell showing an angled slice through two bundles of gas vesicles in the cytosol. FIG. 13 Panel G shows representative TEM image of gas vesicles purified from mARG-HEK cells. FIG. 13 Panel H shows Size distribution of gas vesicles expressed in mARG-HEK cells. The mean and standard deviation of both distributions is illustrated as a circle and with error bars. (n=1828) FIG. 13 Panel I shows phase contrast images of mARG-HEK and mCherry-HEK cells 72 hours after induction with 1 µg/mL doxycycline and 5 mM sodium butyrate. FIG. 13 Panel J shows a diagram reporting cell viability of mARG-HEK cells relative to mCherry-HEK cells after 72 hours of gene expression. Error bars indicate SEM. FIG. 13 Panel K shows a chart reporting a fraction of mARG-HEK cells in co-culture with mARG-mCherry cells seeded in equal numbers over 6 days of gene expression (n=3 biological replicates, each from 4 technical replicates, with darker symbols showing the mean). Scale bars in B, F, G represent 500 nm. Scale bar in I represents 20 µm.

FIG. 14 Panel A shows a schematic illustration of the collapse-based ultrasound imaging paradigm used to generate gas vesicle-specific ultrasound contrast from mARG-expressing cells. FIG. 14 Panel B shows a chart reporting a representative non-linear signal recorded during a step change in the incident acoustic pressure, from 0.27 MPa in the white-shaded region to 1.57 MPa in the grey-shaded region, exemplifying BURST ultrasound imaging. FIG. 14 Panel C shows a grayscale version of representative collapse and post-collapse ultrasound images of mARG-HEK and mCherry-HEK cells acquired during this ultrasound imaging paradigm and their difference, indicating gas vesicle-specific contrast. FIG. 14 Panel D shows a chart reporting cellular viability after being insonated under 3.2 MPa acoustic pressures, as measured using the MTT assay. FIG. 14 Panel E shows a schematic representation of a chemically inducible gene circuit with mARG expression as its output. All three mARG cassettes in mARG-HEK cells are under the control of the doxycycline-inducible TRE3G promoter (TRE), with expression triggered by incubation with doxycycline. FIG. 14 Panel F shows a grayscale version of representative ultrasound images and contrast measurements in mARG-HEK cells as a function of time following induction with 1 µg/mL of doxycycline and 5 mM sodium butyrate (n=6, with the darker dots showing the mean). FIG. 14 Panel G shows a grayscale version of representative ultrasound images and contrast measurements in mARG-HEK cells as a function of doxycycline induction concentrations. Cells were allowed to express gas vesicles for 72 hours in the presence of 5 mM sodium butyrate. (n=6, with the darker dots showing the mean). A sigmoidal function is fitted as a visual guide. FIG. 14 Panel H shows a grayscale version of representative ultrasound images and contrast measurements in mARG-HEK cells mixed with mCherry-HEK cells in varying proportions. Cells were induced with 1 µg/mL of doxycycline and 5 mM sodium butyrate for 72 hours prior to imaging. (n=4, with the darker dots showing the mean) FIG. 14 Panel I shows schematic representative and a grayscale version of representative ultrasound images from mARG-HEK cells in Matrigel re-expressing gas vesicles after acoustic collapse. Cells were induced with 1 µg/mL of doxycycline and 5 mM sodium butyrate for 72 hours before and after 3.2 MPa acoustic insonation. Ultrasound images were acquired after an additional 72 hours in culture following collapse. FIG. 14 Panel J shows a chart reporting results of ultrasound contrast in mARG-HEK and mCherry-HEK cells after initial expression, after collapse, after re-expression and after second collapse. (n=7, with the darker dots showing the mean). GV, gas vesicles. All scale bars represent 1 mm.

FIG. 15 Panel A shows a schematic illustration of an approach wherein a mouse implanted with a subcutaneous tumor model, and the related expected spatial pattern of vascularization and doxycycline-induced reporter gene expression. FIG. 15 Panel B shows a chart reporting an exemplary experimental timeline. FIG. 15 Panel C shows a grayscale version of representative ultrasound image of tumors containing mARG-HEK cells after 4 days of doxycycline administration, arrow indicates mARG-specific BURST ultrasound image. mARG-specific contrast shown in the grayscale version of the hot colormap is overlaid on an anatomical B-mode image showing the background anatomy. FIG. 15 Panel D shows a grayscale version of representative ultrasound image of tumors containing mCherry-HEK cells after 4 days of doxycycline administration. FIG. 15 Panel E shows a grayscale version of ultrasound images of adjacent planes in the mARG-HEK tumor acquired at 1 mm intervals. The minimum and maximum values of scale bars in the original ultrasound images of Panels C-E are 4000 and 40000 au, respectively. FIG. 15 Panel F shows a grays scale version of representative fluorescence image of a histological tissue section of a mARG-HEK tumor. The light gray color shows the GFP and mCherry fluorescence around the periphery of the tumor. FIG. 15 Panel G shows a grayscale version of a fluorescence image of a mouse implanted with mARG-HEK and mCherry-HEK tumors on the left and right flanks, respectively, as outlined with arrows, after 4 days of expression. Scale bars for are 1 mm for C—F and 1 cm for G.

FIG. 17 Panel A shows a chart illustrating mCherry fluorescence of mARG-HEK cells induced with 1 µg/mL doxycycline and 5 mM sodium butyrate at the indicated times after induction (n=4, with the darker dots showing the mean). FIG. 17 Panel B shows a chart reporting mCherry fluorescence of mARG-HEK cells with the indicated inducer concentration and 5 mM sodium butyrate after 72 hours of induction (n=7, with the darker dots showing the mean).

In FIG. 22 Panel B, the left column shows ultrasound images of tumors containing mARG-HEK cells re-expressing gas vesicles after an additional 4 days of doxycycline administration. The right column shows ultrasound images of tumors containing mCherry-HEK cells after an additional 4 days of doxycycline administration. Difference heatmap of nonlinear signal between frame 1 and frame 4 is overlaid on a grayscale anatomical ultrasound image. Min and max on color bar represent 4000 and 40000, respectively. White arrows indicate location of mARG-specific BURST ultrasound signal. Scale bars represent 1 mm.

FIG. 24A shows a schematic representation of two gene cassettes integrated to the genome of HEK293-tetON cells. In the top construct gvpB is separated from gvpN by an internal ribosome entry sequence (shown as box between gvpB and gvpN). The promoters, as illustrated by thin arrows are TRE3G doxycycline-inducible promoters. FIG. 24B shows representative TEM image of GVs in the lysate of HEK293-tetON cells transfected with the constructs in (FIG. 24A) and induced with 1 µg/mL doxycycline. FIG. 24C illustrates an alternative consolidated mARG construct comprising of 2 gene cassettes enabling mammalian GV expression. In the top construct gvpB is separated from gvpF by an IRES. The promoters, as illustrated by thin arrows are CMV promoters. FIG. 24D shows a representative BUST ultrasound of HEK293T cells expressing the constructs in FIG. 24C. HEK293T control without GV genes do not produce BURST ultrasound signal.

FIG. 27 shows HEK293T cells transfected with Ana GV genes from Table 10. Cells transfected with the constructs expressed GV proteins for 72 hours before ultrasound imaging. FIG. 27 panel A shows representative BURST ultrasound images of HEK293T cells expressing Ana-gvpA, Ana-gvpC, Ana-gvpN, Ana-gpvJ, Ana-gvpK, Ana-gvpF, Ana-gvpG, Ana-gvpV, Ana-gvpW on the left and Ana-gvpA, Ana-gvpN, Ana-gpvJ, Ana-gvpK, Ana-gvpF, Ana-gvpG, Ana-gvpV, Ana-gvpW on the right. FIG. 27 panel B shows representative nonlinear signals with amplitude modulation ultrasound images of HEK293T cells expressing Ana-gvpA, Ana-gvpC, Ana-gvpN, Ana-gpvJ, Ana-gvpK, Ana-gvpF, Ana-gvpG, Ana-gvpV, Ana-gvpW on the left and Ana-gvpA, Ana-gvpN, Ana-gpvJ, Ana-gvpK, Ana-gvpF, Ana-gvpG, Ana-gvpV, Ana-gvpW on the right.

DETAILED DESCRIPTION

Figure 1:
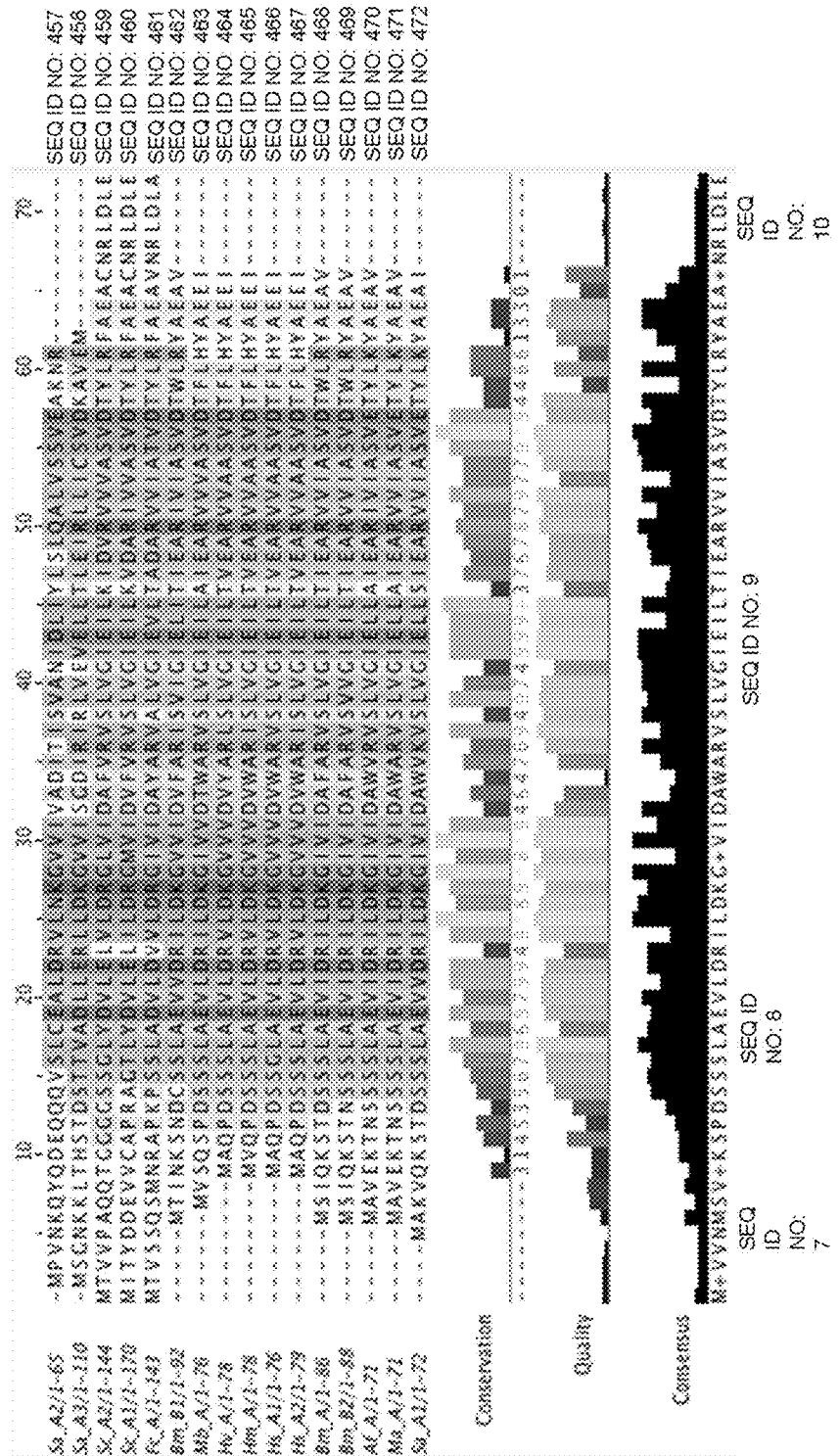
FIG. 1 shows an exemplary Clustal omega alignment of amino acid sequences of selected exemplary gvpA and gvpB proteins (SEQ ID NO: 7-10 and 457-472).

Provided herein are genetically engineered gas vesicle expression systems (GVES) and related polynucleotide constructs configured for expression of a gas vesicle (GV) in a mammalian cell, and related gas vesicle gene clusters, gas vesicles, genetic circuits, vectors, genetically engineered mammalian cells, compositions, methods and systems.

The wordings "gas vesicles", GV", "gas vesicles protein structure", or "GVPS", refer to a gas-filled protein structure natively intracellularly expressed by certain bacteria or archaea as a mechanism to regulate cellular buoyancy in aqueous environments [3]. In particular, gas vesicles are protein structures natively expressed almost exclusively in microorganisms from aquatic habitats, to provide buoyancy by lowering the density of the cells [3]. GVs have been found in over 150 species of prokaryotes, comprising cyanobacteria and bacteria other than cyanobacteria [4, 5], from at least 5 of the 11 phyla of bacteria and 2 of the phyla of archaea described by Woese (1987) [6]. Exemplary microorganisms expressing or carrying gas vesicle protein structures and/or related genes include cyanobacteria such as *Microcystis aeruginosa, Aphanizomenon flos aquae Oscillatoria agardhii, Anabaena, Microchaete diplosiphon* and *Nostoc*; phototropic bacteria such as *Amoebobacter, Thiodiclyon, Pelodiclyon,* and *Ancalochloris*; non phototropic bacteria such as *Microcyclus aquaticus*; Gram-positive bacteria such as *Bacillus megaterium* Gram-negative bacteria such as *Serratia*; and archaea such as *Haloferax mediterranei, Methanosarcina barkeri,* and *Halobacteria salinarium*, as well as additional microorganisms identifiable by a skilled person.

In particular, a GV in the sense of the disclosure is an intracellularly expressed structure forming a hollow structure wherein a gas is enclosed by a protein shell, which is a shell substantially made of protein (at least 95% protein). In gas vesicles in the sense of the disclosure, the protein shell is formed by a plurality of proteins herein also indicated as GV proteins or gvps, which form in the cytoplasm a gas permeable and liquid impermeable protein shell configuration encircling gas. Accordingly, a protein shell of a GV is permeable to gas but not to surrounding liquid such as water. In particular, GV protein shells exclude water but permit gas to freely diffuse in and out from the surrounding media [7] making them physically stable despite their usual nanometer size, unlike microbubbles, which trap pre-loaded gas in an unstable configuration.

GV structures are typically nanostructures with widths and lengths of nanometer dimensions (in particular with widths of 45-250 nm and lengths of 100-800 nm) but can have lengths up to 2 µm in prokaryotes but can have larger dimensions such as up to 8-10 µm as will be understood by a skilled person upon reading of the present disclosure. In certain embodiments, the gas vesicles protein structure have average dimensions of 1000 nm or less, such as 900 nm or less, including 800 nm or less, or 700 nm or less, or 600 nm or less, or 500 nm or less, or 400 nm or less, or 300 nm or less, or 250 nm or less, or 200 nm or less, or 150 nm or less, or 100 nm or less, or 75 nm or less, or 50 nm or less, or 25 nm or less, or 10 nm or less. For example, the average diameter of the gas vesicles may range from 10 nm to 1000 nm, such as 25 nm to 500 nm, including 50 nm to 250 nm, or 100 nm to 250 nm. By "average" is meant the arithmetic mean.

GVs in the sense of the disclosure have different shapes depending on their genetic origins [7]. For example, GVs in the sense of the disclosure can be substantially spherical, ellipsoid, cylindrical, or have other shapes such as football shape or cylindrical with cone shaped end portions depending on the type of bacteria providing the gas vesicles.

Representative examples of endogenously expressed GVs native to bacterial or archaeal species are the gas vesicle protein structure produced by the Cyanobacterium *Anabaena flos-aquae* (Ana GVs) [3], and the *Halobacterium Halobacterium salinarum* (Halo GVs) [8]. In particular, Ana GVs are cone-tipped cylindrical structures with a diameter of approximately 140 nm and length of up to 2 μm and in particular 200-800 nm or longer. Halo GVs are typically spindle-like structures with a maximal diameter of approximately 250 nm and length of 250-600 nm.

In bacteria or archaea expressing GVs, the genes (herein also gvp genes) encoding for the proteins forming the GVs (herein also GV proteins), are organized in a gas vesicle gene cluster of 8 to 14 different genes depending on the host bacteria or archaea, as will be understood by a skilled person.

The term "Gas Vesicle Genes Cluster" or "GVGC" as described herein indicates a gene cluster encoding a set of GV proteins capable of providing a GV upon expression within a bacterial or archaeal cell Since the ability of expressed GV proteins to assemble in a GV depends on the cell environment where GV proteins are expressed and a same group of gvp genes may or may not form a GV upon expression in a cell, gvp genes provide GVGCs in a cell dependent manner as will be understood by a skilled person (see on point U.S. application Ser. No. 15/663,635 published as US 2018/0030501).

The term "gene cluster" as used herein means a group of two or more genes found within an organism's DNA that encode two or more polypeptides or proteins, which collectively share a generalized function or are genetically regulated together to produce a cellular structure and are often located within a few thousand base pairs of each other. The size of gene clusters can vary significantly, from a few genes to several hundred genes [9]. Portions of the DNA sequence of each gene within a gene cluster are sometimes found to be similar or identical; however, the resulting protein of each gene is distinctive from the resulting protein of another gene within the cluster. Genes found in a gene cluster can be observed near one another on the same chromosome or native plasmid DNA, or on different, but homologous chromosomes. An example of a gene cluster is the Hox gene, which is made up of eight genes and is part of the Homeobox gene family. In the sense of the disclosure, gene clusters as described herein also comprise gas vesicle gene clusters, wherein the expressed proteins thereof together are able to form gas vesicles.

The term "gene" as used herein indicates a polynucleotide encoding for a protein that in some instances can take the form of a unit of genomic DNA within a bacteria, plant, or other organism. The term gene as used herein incudes naturally occurring polynucleotide encoding for a protein as well as engineered polynucleotide whose sequences have been modified from the original sequence for example to optimize expression, e.g. through codon changes (see Examples section) and/or through introduction of modified N- and/or C-terminal modifications, while still maintaining the ability to encode for the protein encoded by the naturally occurring polynucleotide or a or a functional variant thereof.

The term "polynucleotide" as used herein indicates an organic polymer composed of two or more monomers including nucleotides, nucleosides or analogs thereof. The term "nucleotide" refers to any of several compounds that consist of a ribose or deoxyribose sugar joined to a purine or pyrimidine base and to a phosphate group and that are the basic structural units of nucleic acids. The term "nucleoside" refers to a compound (as guanosine or adenosine) that consists of a purine or pyrimidine base combined with deoxyribose or ribose and is found especially in nucleic acids. The term "nucleotide analog" or "nucleoside analog" refers respectively to a nucleotide or nucleoside in which one or more individual atoms have been replaced with a different atom or a with a different functional group. Accordingly, the term polynucleotide includes nucleic acids of any length, and in particular DNA RNA analogs and fragments thereof.

The term "protein" as used herein indicates a polypeptide with a particular secondary and tertiary structure that can interact with another molecule and in particular, with other biomolecules including other proteins, DNA, RNA, lipids, metabolites, hormones, chemokines, and/or small molecules. The term "polypeptide" as used herein indicates an organic linear, circular, or branched polymer composed of two or more amino acid monomers and/or analogs thereof. The term "polypeptide" includes amino acid polymers of any length including full-length proteins and peptides, as well as analogs and fragments thereof. A polypeptide of three or more amino acids is also called a protein oligomer, peptide, or oligopeptide. In particular, the terms "peptide" and "oligopeptide" usually indicate a polypeptide with less than 100 amino acid monomers. In particular, in a protein, the polypeptide provides the primary structure of the protein, wherein the term "primary structure" of a protein refers to the sequence of amino acids in the polypeptide chain covalently linked to form the polypeptide polymer. A protein "sequence" indicates the order of the amino acids that form the primary structure. Covalent bonds between amino acids within the primary structure can include peptide bonds or disulfide bonds, and additional bonds identifiable by a skilled person. Polypeptides in the sense of the present disclosure are usually composed of a linear chain of alpha-amino acid residues covalently linked by peptide bond or a synthetic covalent linkage. The two ends of the linear polypeptide chain encompassing the terminal residues and the adjacent segment are referred to as the carboxyl terminus (C-terminus) and the amino terminus (N-terminus) based on the nature of the free group on each extremity. Unless otherwise indicated, counting of residues in a polypeptide is performed from the N-terminal end ($NH_2$-group), which is the end where the amino group is not involved in a peptide bond to the C-terminal end (—COOH group) which is the end where a COOH group is not involved in a peptide bond. Proteins and polypeptides can be identified by x-ray crystallography, direct sequencing, immunoprecipitation, and a variety of other methods as understood by a person skilled in the art. Proteins can be provided in vitro or in vivo by several methods identifiable by a skilled person. In some instances where the proteins are synthetic proteins in at least a portion of the polymer two or more amino acid monomers and/or analogs thereof are joined through chemically-mediated condensation of an organic acid (—COOH) and an amine (—NH$_2$) to form an amide bond or a "peptide" bond.

As used herein the term "amino acid", "amino acid monomer", or "amino acid residue" refers to organic compounds composed of amine and carboxylic acid functional groups, along with a side-chain specific to each amino acid. In particular, alpha- or α-amino acid refers to organic compounds composed of amine (—NH$_2$) and carboxylic acid (—COOH), and a side-chain specific to each amino acid connected to an alpha carbon. Different amino acids have different side chains and have distinctive characteristics, such as charge, polarity, aromaticity, reduction potential, hydrophobicity, and pKa. Amino acids can be covalently linked to form a polymer through peptide bonds by reactions between the amine group of a first amino acid and the carboxylic acid group of a second amino acid. Amino acid in the sense of the disclosure refers to any of the twenty naturally occurring amino acids, non-natural amino acids, and includes both D an L optical isomers.

In embodiments herein described identification of a gene cluster encoding GV proteins naturally expressed in bacteria or archaea as described herein can be performed for example by isolating the GVs from the bacteria or archaea, isolating the protein for the protein shell of the GV and deriving the related amino acidic sequence with methods and techniques identifiable by a skilled person (see e.g. procedures described in [10] [11]). The sequence of the genes encoding for the GV proteins can then be identified by methods and techniques identifiable by a skilled person. For example, gas vesicle gene clusters can also be identified by persons skilled in the art by performing gene sequencing or partial- or whole-genome sequencing of organisms using wet lab and in silico molecular biology techniques known to those skilled in the art. As understood by those skilled in the art, gas vesicle gene clusters can be located on the chromosomal DNA or native plasmid DNA of microorganisms. After performing DNA or cDNA isolation from a microorganism, the polynucleotide sequences or fragments thereof or PCR-amplified fragments thereof can be sequenced using DNA sequencing methods such as Sanger sequencing, DNASeq, RNASeq, whole genome sequencing, and other methods known in the art using commercially available DNA sequencing reagents and equipment, and then the DNA sequences analyzed using computer programs for DNA sequence analysis known to skilled persons.

In some embodiments, identification of a gene cluster encoding for GV proteins [8, 12, 13] can also be performed by screening DNA sequence databases such as GenBank, EMBL, DNA Data Bank of Japan, and others. Gas vesicle gene cluster gene sequences in databases such as those above can be searched using tools such as NCBI Nucleotide BLAST and the like, for gas vesicle gene sequences and homologs thereof, using gene sequence query methods known to those skilled in the art. For example, genes of the gene cluster for the exemplary haloarchael GVs (which have the largest number of different gvp genes) and their predicted function and features are illustrated in Example 26 of related U.S. application Ser. No. 15/613,104, filed on Jun. 2, 2017 which is incorporated herein by reference in its entirety. GV gene clusters can also be identified using a combination of genomic vicinity (e.g. antiSMASH), protein homology and prior GV gene annotation as will be understood by a skilled person.

A GV gene cluster encoding for GV proteins typically comprises Gas Vesicle Assembly (GVA) genes and Gas Vesicle Structural (GVS) genes.

The term Gas Vesicle Structural (GVS) proteins as used herein indicates proteins forming part of a gas-filled protein structure intracellularly expressed by certain bacteria or archaea and can be used as a mechanism to regulate cellular buoyancy in aqueous environments [7]. In particular, GVS shell comprises a GVS identified as gvpA or gvpB (herein also referred to as gvpA/B) and optionally also a GVS identified as gvpC.

In particular, gvpB gene is a gene encoding for gas vesicle structural protein B. gvpB genes is highly homologous to gvpA gene encoding for gas vesicle structural protein A. A gvp A/B is a protein of the GV shell that has a higher than 60% and possibly higher than 70% identity to the following consensus sequence: SSSLAEVLDRILDKGXVIDAWARVSLVGIEILTIEARVVIASVDTYLR (SEQ ID NO: 3) wherein X can be any amino acid. In particular in a gvpA/B of prokaryotes, the consensus sequence of SEQ ID NO: 3 typically forms a conserved secondary structure having an alpha-beta-beta-alpha structural motif formed by portions of the consensus sequence comprising the amino acids LDRILD (SEQ ID NO:4) having an alpha helical structure, RILDKGXVIDAWARVS (SEQ ID NO:5) wherein X can be any amino acid, having a beta strand, beta strand structure, and DTYLR (SEQ ID NO:6) having an alpha helical structure, as will be understood by a skilled person.

As used herein, "homology", "sequence identity" or "identity" in the context of two nucleic acid or polypeptide sequences makes reference to the nucleotide bases or residues in the two sequences that are the same when aligned for maximum correspondence over a specified comparison window. When percentage of sequence identity or similarity is used in reference to proteins, it is recognized that residue positions which are not identical often differ by conservative amino acid substitutions, where amino acid residues are substituted with a functionally equivalent residue of the amino acid residues with similar physiochemical properties and therefore do not change the functional properties of the molecule.

A functionally equivalent residue of an amino acid used herein typically refers to other amino acid residues having physiochemical and stereochemical characteristics substantially similar to the original amino acid. The physiochemical properties include water solubility (hydrophobicity or hydrophilicity), dielectric and electrochemical properties, physiological pH, partial charge of side chains (positive, negative or neutral) and other properties identifiable to a person skilled in the art. The stereochemical characteristics include spatial and conformational arrangement of the amino acids and their chirality. For example, glutamic acid is considered to be a functionally equivalent residue to aspartic acid in the sense of the current disclosure. Tyrosine and tryptophan are considered as functionally equivalent residues to phenylalanine. Arginine and lysine are considered as functionally equivalent residues to histidine.

A person skilled in the art would understand that similarity between sequences is typically measured by a process that comprises the steps of aligning the two polypeptide or polynucleotide sequences to form aligned sequences, then detecting the number of matched characters, i.e. characters similar or identical between the two aligned sequences, and calculating the total number of matched characters divided by the total number of aligned characters in each polypeptide or polynucleotide sequence, including gaps. The similarity result is expressed as a percentage of identity.

As used herein, "percentage of sequence identity" means the value determined by comparing two optimally aligned sequences over a comparison window, wherein the portion of the polynucleotide sequence in the comparison window may comprise additions or deletions (gaps) as compared to the reference sequence (which does not comprise additions or deletions) for optimal alignment of the two sequences. The percentage is calculated by determining the number of positions at which the identical nucleic acid base or amino acid residue occurs in both sequences to yield the number of matched positions, dividing the number of matched positions by the total number of positions in the window of comparison, and multiplying the result by 100 to yield the percentage of sequence identity.

As used herein, "reference sequence" is a defined sequence used as a basis for sequence comparison. A reference sequence may be a subset or the entirety of a specified sequence; for example, as a segment of a full-length protein or protein fragment. A reference sequence can comprise, for example, a sequence identifiable a database such as GenBank and UniProt and others identifiable to those skilled in the art.

As understood by those skilled in the art, determination of percent identity between any two sequences can be accomplished using a mathematical algorithm. Non-limiting examples of such mathematical algorithms are the algorithm of Myers and Miller [14], the local homology algorithm of Smith et al. [15]; the homology alignment algorithm of Needleman and Wunsch [16]; the search-for-similarity-method of Pearson and Lipman [17]; the algorithm of Karlin and Altschul [18], modified as in Karlin and Altschul [19]. Computer implementations of these mathematical algorithms can be utilized for comparison of sequences to determine sequence identity. Such implementations include, but are not limited to: CLUSTAL in the PC/Gene program (available from Intelligenetics, Mountain View, Calif.); the ALIGN program (Version 2.0) and GAP, BESTFIT, BLAST, FASTA [17], and TFASTA in the Wisconsin Genetics Software Package, Version 8 (available from Genetics Computer Group (GCG), 575 Science Drive, Madison, Wis., USA). Alignments using these programs can be performed using the default parameters.

Thus, a gvpA/B protein in a prokaryote of interest can be identified for example by isolating GVs from a prokaryote of interest, isolating the protein from the protein shell of the GV and obtaining the amino acid sequence of the isolated protein. In addition or in the alternative to the isolating the GVs and isolating the protein, the method can include obtaining amino acidic sequences of the shell proteins of the GV of the prokaryote of interest from available database. The method further comprises performing a sequence alignment of the obtained amino acidic sequences against the gvpA/B protein consensus sequence of SEQ ID NO:3.

In particular the isolating GVs from a prokaryote of interest can be performed following methods to isolate gas vesicles as described in U.S. application Ser. No. 15/613,104, filed on Jun. 2, 2017. The isolating the protein for the protein shell of the GV and obtaining the related amino acidic sequence can be performed with tandem liquid chromatography mass-spectrometry alone or in combination with obtaining amino acid sequences of the isolated protein with wet lab techniques or from available databases comprising the sequences of the prokaryote of interest as well as additional techniques and approaches identifiable by a skilled person. Obtaining amino acid sequences of GV shell proteins of the prokaryote of interest can be performed by screening available databases of gene and protein sequences identifiable by a skilled person. Performing a sequence alignment of the sequences of the isolated GV proteins or proteins encoded in the genome of a prokaryote of interest can be performed (using Protein BLAST or other alignment algorithms known in the art) against the gvpA/B protein consensus sequence of SEQ ID NO:3. In particular, a sequence alignment can be performed using gvpA/B protein sequences from the closest phylogenetic relative to the prokaryote of interest. Reference is made to Example 1 showing exemplary phylogenetic relationships between gvpA/B proteins of exemplary prokaryotic species.

The optional gvpC gene encodes for a gvpC protein which is a hydrophilic protein of a GV shell, including repetitions of one repeat region flanked by an N-terminal region and a C terminal region. The term "repeat region" or "repeat" as used herein with reference to a protein refers to the minimum sequence that is present within the protein in multiple repetitions along the protein sequence without any gaps. Accordingly, in a gvpC multiple repetitions of a same repeat is flanked by an N-terminal region and a C-terminal region. In a same gvpC, repetitions of a same repeat in the gvpC protein can have different lengths and different sequence identity one with respect to another.

Repeat regions within any given gvpC sequence 'X' from organism 'Y' can be identified by comparing the related sequence with the sequence of a known gvpC (herein e.g. reference gvpC sequence "Z"). In particular, the comparing can be performed by aligning sequence 'X' to the reference gvpC sequence 7' using a sequence alignment tools such as BLASTP or other sequence alignment tools identifiable by a skilled person at the date of filing of the application upon reading of the present disclosure. In particular, a reference sequence 7' is chosen from a host that is the closest phylogenetic relative of 'Y', from a list of *Anabaena flos-aquae*, *Halobacterium salinarum*, *Haloferax mediditerranei*, *Microchaetae diplosiphon* and *Nostoc* sp. The sequence alignment of 'X' and 'Z' (e.g. a BLASTP) is performed by performing a first alignment of sequence X and sequence Z to identify a beginning and an end of a repeat in 'X as well as a number of repetition of the identified repeat, in accordance with the known repeats in 'Z'. The first alignment results in at least one first aligned portion of X with respect to reference sequence Z. The aligning can also comprises performing a second alignment between the at least one first aligned portion of X identified following the first alignment and additional portions of X to identify at least one repeat 'R1' in X. Other repeats in 'X' (i.e. R2, R3, R4 . . . ) can subsequently be identified with respect to R1. In performing alignment steps sequence are identified as repeat when the sequence shows at least 3 or more of the characteristics described in U.S. application Ser. No. 15/663,635 published as US 2018/0030501 (incorporated herein by reference in its entirety) which also include additional features of gvpC proteins and the related identification.

In a GVGC, the GVS genes are comprised with Gas Vesicle Assembly genes. The Gas Vesicle Assembly genes are genes encoding for GVA proteins. GVA proteins comprise proteins with various putative functions such as nucleators and/or chaperons as well as proteins with an unknown specific function related to the assembly of the GV.

In a prokaryotic cell GVA genes are all the genes within one or more operons comprising at least one of a gvpN and a gvpF excluding any gvpA/B and gvpC gene possibly present within said one or more operons. Therefore GVA genes can be identified by identifying an operon in a prokaryote including at least one of a gvpN and a gvpF excluding any gvpA/B and gvpC gene.

Preferably the one or more operons comprising all the GVA genes of a prokaryote can be identified and detected by detecting a gvpN gene encoding for a GV protein consensus sequence RALXYLQAGYXVHXRGPAGTGKTTLAM-HLAXXLXRPVMLIXGDDEFXTSDLIGSESGY XXKKVVDNYIHSVVKVEDELRQNWVDNRLTXA-CREGFTLVYDEFNRSRPEXNNVLLS VLEEKILXLP (SEQ ID NO: 1) wherein X indicates any amino acid or a sequence of any length having at least 50%, and more preferably 60% or higher, most preferably from 50% to 83% identity.

gvpN genes of various microorganisms have a sequence encoding for a gvpN protein within the consensus SEQ ID NO: 1. In particular, gvpN gene in the sense of the disclosure can be a gene encoding for sequence MTVLTDKRKKGSGAFIQDDETKEVLSRAL-SYLKSGYSIHFTGPAGGGKTSLARALAKKR KRPVMLMHGN-HELNNKDLIGDFTGYTSKKVIDQYVRSVYKKD-EQVSENWQDGRLLEA VKNGYTLIYDEFTRSKPATN-NIFLSILEEGVLPLYGVKMTDPFVRVHPDFRVIFTS-NPAEY AGVYDTQDALLDRLITMFIDYKDIDRETAIL-TEKTDVEEDEARTIVTLVANVRNRSGDEN SSGLSL-RASLMIATLATQQDIPIDGSDEDFQTLCI-DILHHPLTKCLDEENAKSKAEKIILEE CKNIDTEEK (SEQ ID NO: 11) or a sequence of any length having at least 30% sequence identity with respect to SEQ ID NO:11, preferably at least 50%, and more preferably 60% or higher, and gvpF gene in the sense of the disclosure can be a gene encoding for sequence MSETNETGIYIFSAI-QTDKDEEFGAVEVEGTKAETFLIRYK-DAAMVAAEVPMKIYHPNR QNLLMHQ-NAVAAIMDKNDTVIPISFGNVFKSKEDVKVLLEN-LYPQFEKLFPAIKGKIEVG LKVIGKKEWLEKKVNEN-PELEKVSASVKGKSEAAGYYERIQLGG-MAQKMFTSLQKEV KTDVFSPLEEAAEAAKANEPT-GETMLLNASFLINREDEAKFDEKVNEAHENWKD-KADF HYSGPWPAYNFVNIRLKVEEK (SEQ ID NO:12) or a sequence of any length having at least 20% sequence identity with respect to SEQ ID NO:12, preferably at least 50%, more preferably 60%, and at least 70% or higher.

The term "operon" as described herein indicates a group of genes arranged in tandem in a prokaryotic genome as will be understood by a skilled person. Operons typically encode proteins participating in a common pathway as understood by those skilled in the art. Typically, genes of an operon are transcribed together into a single mRNA molecule referred to as polycistronic mRNA. Polycistronic mRNA comprises several open reading frames (ORFs), each of which is translated into a polypeptide. These polypeptides usually have a related function and their coding sequence is grouped and regulated together in a regulatory region, containing a promoter and an operator. Typically, repressor proteins bound to the operator sequence can physically obstruct the RNA polymerase enzyme from binding the promoter, preventing transcription. An example of a prokaryotic operon is the lac operon, which natively regulates transport and metabolism of lactose in *E. coli* and many other enteric bacteria.

In an operon, each ORF typically has its own ribosome binding site (RBS) so that ribosomes simultaneously translate ORFs on the same mRNA. Some operons also exhibit translational coupling, where the translation rates of multiple ORFs within an operon are linked. This can occur when the ribosome remains attached at the end of an ORF and translocates along to the next ORF without the need for a new RBS. Translational coupling is also observed when translation of an ORF affects the accessibility of the next RBS through changes in RNA secondary structure.

In some embodiments, a GV cluster comprises one of gvpN or gvpF. In several embodiments GV clusters include both gvpN and gvpF as will be understood by a skilled person. In this connection, reference is made to Example 12 and FIGS. 20 and 21 of related application U.S. application Ser. No. 15/663,635 published as US 2018/0030501 incorporated herein by reference in its entirety, showing exemplary gas vesicle gene clusters operons [1, 2] comprising GVS and GVA genes and related exemplary configuration. In particular, as shown in Example 12 of related application U.S. application Ser. No. 15/663,635 published as US 2018/0030501, typically a native GV gene cluster has GVA genes comprising both gvpN and gvpF genes, even if native GV gene clusters are known having a gvpN gene or a gvpF gene, as understood by skilled persons.

Accordingly, for a certain prokaryote, GVA genes in the sense of the disclosure indicate all the genes that are comprised in the one or more operons having at least one of a gvpN and/or a gvpF herein described and excluding any Gas Vesicle Structural (GVS) genes of the prokaryotes possibly comprised within the one or more operons.

Thus, GVA genes comprised in a gas vesicle gene cluster in a prokaryote can be identified for example by obtaining genome sequence of the prokaryote of interest and performing a sequence alignment of the protein sequences encoded in the genome of the prokaryote of interest against a gvpN protein sequence and/or a gvpF protein sequence.

In particular, obtaining the genome sequence of the prokaryote of interest, can be performed either using wet lab techniques identifiable by a skilled person upon reading of the present disclosure, or obtained from databases of gene and protein sequences also identifiable by a skilled person upon reading of the present disclosure. Performing a sequence alignment of the protein sequences encoded in the genome of the prokaryote of interest can per performed using Protein BLAST or other alignment algorithms identifiable by a skilled person. Exemplary gvpN protein sequence and/or a gvpF protein sequence, that can be used in performing the alignment are sequences SEQ ID NO:11 and/or SEQ ID NO:12. In particular, a sequence alignment can be performed using gvpN and/or gvpF protein sequences from the closest phylogenetic relative to the prokaryote of interest. Reference is made to Example 2 showing exemplary phylogenetic relationships between gvpF and gvpN proteins of exemplary prokaryotic species. Accordingly, one or more operons that comprise the gvpN and/or gvpF genes can be identified, and any other gvps within the one or more operons can also be identified, wherein the other gvps are comprised in ORFs within the one or more operons, excluding any ORFs encoding gvpA/B or gvpC genes comprised in the one or more operons of the GV gene cluster.

Accordingly, GVA genes can also be identified based on the configuration of operon and Gene Clusters identified through homology (see e.g. Example 1), phylogenesis (see e.g. Example 2) also using the gvpA/B, gvpN and/or gvpF consensus of SEQ ID Nos: 1, 3, and 11-12 herein provided, preferably gvpA/B consensus of SEQ ID NO: 3 and gvpN consensus of SEQ ID NO: 1. Reference is also made in this connection to the indication of Example 3 reporting exemplary GVGC configurations of naturally occurring Gas Vesicle gene clusters identified with method herein described and additional methods identifiable by a skilled person.

GVS genes of a GVGC of the disclosure, identified with methods herein indicated, typically comprise gvpA or gvpB which have similar sequences and are equivalent in their purpose and optionally gvpC. Exemplary sequences for gvpA and gvpB genes of GV gene clusters in the sense of the disclosure, which can also be used to identify additional GVS and GVGC through homology and alignment in addition to the use of the consensus sequence SEQ ID NO: 3, are reported in Example 4.

GVA genes of a GVGC of the disclosure, identified with methods herein indicated, typically comprise proteins identified as gvpF, gvpG, gvpL, gvpS, gvpK, gvpJ, and gvpU. GVA genes and proteins can also comprise gvpR and gvpT (see e.g. *B. megaterium* GVA) gvpV, gvpW (se *Anaboena flos* ague and *Serratia* GVA) and/or gvp X, gvp Y and gvp Z (see e.g. *Serratiai* GVA. Preferably GVGC of the disclosure further comprise gvpN which result in a more robust detection with many detection methods herein described. Exemplary sequences for GVA genes of GV gene clusters in the sense of the disclosure which can also be used to identify additional GVAs and GVGC through homology and alignment are reported in Example 4.

In GVGC herein described co-expression of the GVS genes and the GVA genes in connection with regulatory sequence capable of operating in a host cell are configured to provide a GV type, with a different GVGC typically resulting in a different GV type.

The wording "GV type" in the sense of the disclosure indicates a gas vesicle having dimensions and shape resulting in distinctive mechanical, acoustic, surface and/or magnetic properties as will be understood by a skilled person upon reading of the present disclosure. In particular, a skilled person will understand that different shapes and dimensions will result in different properties in view of the indications in provided in U.S. applicant Ser. No. 15/613,104 published as US2018/0028693 and U.S. Ser. No. 15/663,600 published as US2018/0038922 and additional indications identifiable by a skilled person Typically, larger volume results in stronger per-particle scattering, smaller diameter generally results in higher collapse pressure after removal of gvpC, and different dimensions result in different ratios of T2/T2* relaxivity per volume-averaged magnetic susceptibility ([20]).

Accordingly, in embodiments herein described, GVGC can be selected based on desired properties of the corresponding GV type. In particular, to this extent, a skilled person can use naturally occurring GVGC, can provide engineered GVGC wherein some of the naturally occurring gvp genes are omitted, and/or can provide hybrid GVGC in which GVAs and GVS genes of naturally occurring GVGCs are combined to provide GV types having the shape and dimensions resulting in the desired properties.

The term "hybrid gene cluster" or "hybrid cluster" as used herein indicates a cluster comprising at least two genes native to different species and resulting in a cluster not natively in any organisms. Typically, a hybrid gene cluster comprises a subset of gas vesicle genes native to a first bacterial species and another subsets of gas vesicle genes native to one or more bacterial species, with at least one of the one or more bacterial species different from the first bacterial specie Accordingly, a hybrid GV gene clusters includes a combination of GV genes which is not native in any naturally occurring prokaryotes.

In particular, identification of a desired GVGC for a target cell and therefore of the ability of the corresponding gvp genes combination to result in production of functional GV proteins capable of assembling in a GV thus providing a corresponding detectable GV type can be performed through a testing method also directed to verify detectability of the GV by a detection method of choice. The testing method can be performed in the target cell where detection of the GV type is desired or in testing cells having a cell environment equivalent to the cell environment of the target cell in terms of expression of GV genes and GV formation and thus provide a model to verify ability of the gvp genes to provide a GVGC for the target cells. In the method to identify a desired GVGC the introducing can be performed using engineered polynucleotide constructs contacted with the target cell or testing cell for a time and under conditions to allow expression of the GVGC and formation of the GV type (e.g. using the methods described in U.S. application Ser. No. 15/663,635 published as US 2018/0030501 incorporated herein by reference). The method further comprises detecting formation of a gas vesicle in the target cell or testing cell following the introducing with a pre-set method of detection. Preset methods of detection can be directed to detect acoustic and/or magnetic properties that are of interest in desired applications of the corresponding GV type. Preferably the testing can be performed in a target cell or testing cell, that have been modified, either chemically or genetically, to have the same cellular turgor pressure as mammalian cells according to methods identifiable by a skilled person.

Experiments performed with GVGC herein described provide proof of principle that *E. coli* is an effective model for ability of a GVGC to correctly assemble in mammalian cell environment and that therefore can be used as a testing cell GVGC capable of mammalian cells. Accordingly, detecting expression of a candidate GVGC in *E. coli* with a pre-set method is indicative of the ability of the corresponding GV proteins to form a GV type and of the GV type to correctly assemble and be detectable with the pre-set method in a mammalian cell.

Experiments performed with GVGC herein described provide proof of principle that *E. coli* is an effective model for ability of a GVGC to correctly assemble in mammalian cell environment and that detecting expression of a candidate GVGC in *E. coli* with a pre-set method is indicative of the ability of the corresponding GV type to correctly assemble and be detectable with the pre-set method in a mammalian cell.

In exemplary embodiments where a GV type is to be used in differential ultrasound imaging or image-subtracted ultrasound, the pre-set method of detection can comprise imaging with ultrasound a target site comprising the cell following the introduction of the GVGC, applying acoustic pressure to the target site at a pressure expected to collapse the GVs and then imaging the target site with ultrasound again, and the difference of the images (before and after collapse) shows if collapsing GVs (having a collapse threshold below the acoustic pressure) were present at the target site.

In exemplary embodiments where a GV type is to be used in MRI (magnetic resonance imaging), imaging, the pre-set method of detection can comprise imaging with MRI a target site comprising the cell following the introduction of the GVGC, applying hydrostatic pressure to the target site at a pressure expected to collapse the GVs. The target site is then imaged with MRI again, and the difference of the images (before and after collapse) shows if collapsing GVs (having a collapse threshold below the hydrostatic pressure) were present at the target site.

In exemplary embodiments where a GV type is to be used in BURST (burst ultrasound reconstruction with signal templates) imaging described herein and in U.S. application Ser. No. 16/736,581 filed on Jan. 7, 2020 and herein incorporated by reference in its entirety, the pre-set method of detection can comprise imaging with ultrasound a target site comprising the cell following the introduction of the GVGC, over successive frames, at a peak positive pressure (PPP) well below the expected collapse threshold pressure for the GVs. While the frames are being taken, increasing the PPP step-wise to a value over the expected collapse threshold pressure for at least 9 half-cycles. Frames from before, during, and after the application of the increased pressure undergo template mixing to detect a BURST signal from the collapsing GVs, if present.

Additional methods of detection such as Transmission Electron Microscopy (TEM) and optical scattering, optical phase detection, xenon hyperCEST MRI can be used.

An exemplary method of detection of a functional GVGC in the sense of the disclosure performed in *E. Coli* is reported in Example 5 of the present disclosure. Additional methods to be performed other prokaryotic cells and/or mammalian cells using the GVES of the disclosure can be identified by a skilled person upon reading of the present disclosure.

Several detectable GVGC with one or more detection method of interests have been identified and can be used for production of GV types in various cells through various genetically engineered constructs as will be understood by a skilled person upon reading of the present disclosure and U.S. application Ser. No. 15/663,635 published as US 2018/0030501 herein incorporated by reference in its entirety.

In some embodiments described herein GVGC of the instant disclosure can be naturally occurring combination of gvp genes which can have a naturally occurring sequence or a sequence modified to optimize the expression in the cell where detection is to be performed. For example GVGC clusters of the instant disclosure comprise a GVGC of *B. megaterium* formed by the gvpA or gvpB genes, gvpR, gvpN gvpF, gvpG, gvpL gvpS, gvpK, gvpJ, gvpT, gvpU of *B. megaterium*, or the GVGC of *Anaboena Flos Aquae* formed by the gvpA or gvpB genes of *Anaboena Flos Aquae* (see e.g. the sequences in Table 6 of Example 4) and the GVA gvpC, gvpN, gvpJ, gvpK, gvpF, gvpG, gvpV, gvpW of *Anaboena Flos Aquae* (see e.g. sequences in Table 10 of Example 4).

The gvp genes in one or more genes of the GVGC cluster of the present disclosure can have a naturally occurring sequence or a sequence modified to optimize the expression in the cell where detection is to be performed. For example a *B. megaterium* GVGC can have a gvpA or gvpB genes having the sequences in Table 6 of Example 4, and/or any one of the gvpR, gvpN gvpF, gvpG, gvpL gvpS, gvpK, gvpJ, gvpT, gvpU genes having the sequences in Table 8 of Example 4. Similarly, an *Anaboena Flos Aquae* GVGC can have the gvpA or gvpB genes having the sequences reported in Table 6 of Example 4 and/or any one of the gvpC, gvpN, gvpJ, gvpK, gvpF, gvpG, gvpV, gvpW having the sequences reported in Table 10 of Example 4.

In some embodiments, described herein, GVGC of the instant disclosure can be modified version of naturally occurring GV gene clusters. An example is provided by the GVGC of *B. megaterium* comprising gvpB, gvpR, gvpN gvpF, gvpG, gvpL gvpS, gvpK, gvpJ, gvpT, gvpU wherein the gvpR and gvpT genes of the naturally occurring GVGC from *B. megaterium* have been omitted (see e.g. the sequences reported in Example 6 and Table 9 of the instant disclosure). Another example is provided by GV gene clusters comprising gvpA, Ana-gvpC gvpN, gpvJ, gvpK, gvpF, gvpG, gvpW, and gvpV from *Anabaena flos-aquae* or GV gene clusters comprising gvpA+gvpN, gpvJ, gvpK, gvpF, gvpG, gvpW, gvpV from *Anabaena flos-aquae* (see *Anabaena flos-aquae* genes in Table 4 and Table 10 of Example 4 of the present disclosure).

In other embodiments described herein, GVGC of the instant disclosure can be a hybrid GV gene cluster in a Gas Vesicle expression system of the disclosure, can comprise a combination of genes from *A. flos-aquae* (herein also Ana-gvp) and genes from *B. megaterium* (herein also Mega-gvp). In particular, in exemplary embodiments, the hybrid GV gene cluster can comprise *B. megaterium* GVA assembly genes gvpR, gvpN, gvpF, gvpG, gvpL, gvpS, gvpK, gvpJ, gvpT and gvpU and further comprise structural gvpA gene from *Anabaena flos-aquae*. In some of those embodiments, the hybrid GV gene cluster can comprise gvpA, gvpC from *Anabaena flos-aquae* and GVA genes from *B. megaterium* possibly excluding gvpR and/or gvpT. In some of those embodiments, the hybrid GV gene cluster can comprise Ana-gvpA and mega GVA genes possibly excluding gvpR and/or gvpT. In some embodiments GVGC of the instant disclosure can include gvpA, gvpC, gvpN from *Anabaena flos-aquae* and GVA genes from *B. megaterium*, as well as other combinations identifiable by a skilled person upon reading of the present disclosure.

In some embodiments herein described, a GVGC comprising gvp genes A/B, C and N (gvpA/B, gvpC, gvpN genes) from a same or different prokaryote. Preferably the GVGC comprises a gvpN gene as presence of gvpN protein results in an increased detectability of the related GV type.

For example, in one exemplary embodiment, all the gvp genes B, N, F, G, L, S, K, J and U are from *B. megaterium*. GVs from *B. megaterium* are typically cone-tipped cylindrical structures with a diameter of approximately 73 nm and length of 100-600 nm, encoded by a cluster of eleven or fourteen different genes, including the primary structural protein, gvpB, and several putative minor components and putative chaperones [21, 22] as would be understood by a person skilled in the art.

In some embodiments, some of the set of nine gvp genes can be from *Bacillus megaterium* and the rest genes are from *Anabaena flos-aquae* such as the GVGC comprising Ana-A, Ana-C, Ana-N, mega: gvpF, gvpG, gvpL, gvpS, gvpK, gvpJ, gvpT and gvpU with/without gvpR and gvpT, and additional examples identifiable by a skilled person upon reading of the present disclosure (see Example 4 and Example 5 of the present disclosure).

In embodiments herein described, the sequences of at least one gvp gene can be modified with respect to the natural occurring sequence to improve the related expression (e.g. to be codon optimized) and/or the inclusion in the GVES of the disclosure (e.g. by modification of the N- and/or C-terminal portions to allow the use of linker or other elements to be included in a cassette or construct of the disclosure).

In some embodiments, the GVGC can comprise *Serratia* gvp genes as *Serratia* GVs can express functional GV proteins in *E. coli*, as reported in literature ([23] [24]).

GVES and related constructs have been herein provided based on the surprising finding that a naturally occurring, or engineered GVGC (e.g. modified to remove or add gvp genes, to include one or more gvp genes with a modified sequence, and/or to include gvp genes from different prokaryotes to provide a hybrid cluster) which is functional in *E. Coli* can be expressed in mammalian cells on an engineered polynucleotide construct specifically configured to allow expression in the mammalian cell of GV proteins encoded by the GVGC resulting in formation of a corresponding GV type in the mammalian cell.

The term "mammalian cell" refers to cells from a mammal tissue comprising cell within a mammal host and cell isolated from and expanded in culture for use as therapeutic and research tools. Exemplary mammalian cells that can express GVES of the disclosure are primary cells (cells that are directly harvested from an animal and genetically engineered with GVs. Exemplary mammalian cell culture that can be genetically engineered with GV constructs described herein configured to allow expression of GVs comprise HEK 293T, CHO-K1 cells, HEK293, CHO-K1, N2A cells, HeLa, Jurkat, NIH3T3, and other identifiable by those skilled in the art.

In particular, in accordance with the disclosure it has been surprisingly found that naturally occurring, modified and/or hybrid GVGC can be expressed in a mammalian cells if expression of gvpA or gvpB gene is performed in a gene expression cassette separated from the one or more gene expression cassettes used to express the remaining GV genes of the GV gene cluster to be expressed. Also, it has surprisingly be found that gvp genes of a GV gene cluster other than gvpA and/or B can be expressed in a mammalian cells in a single gene expression cassette providing that each gvp gene is separated from another in the same cassette by a separation element encoding a separation peptide possibly in combination with at least one booster cassettes to increase expression of bottleneck genes in the GVGC cluster.

The term "gene cassette" as used herein indicated a mobile genetic element that contains at least one gene and a recombination site. Accordingly, a gene cassette can contain a single gene or multiple genes possibly organized in an operon structure A gene cassette can be transferred from one DNA sequence (usually on a vector) to another by 'cutting' the fragment out using restriction enzymes or transposase, cripr, viral and/or recombinase enzymes and other nucleases and 'pasting' it back into the new context or other molecular biology and cloning techniques (e.g. per, CRISPR, TALENs, ZFN). Gene cassettes can move around within an organism's genome or be transferred to another organism in the environment via horizontal gene transfer.

A "gene expression cassette" is a gene cassette comprising regulatory sequence to be expressed by a transfected cell. Following transformation, the expression cassette directs the cell's machinery to make RNA and proteins. Some expression cassettes are designed for modular cloning of protein-encoding sequences so that the same cassette can easily be altered to make different proteins. An expression cassette is composed of one or more genes and the sequences controlling their expression. An expression cassette typically comprises at least three components: a promoter sequence, an open reading frame, and a 3' untranslated region that, in eukaryotes, usually contains a polyadenylation site. An expression cassette can be formed by manipulable fragment of DNA carrying, and capable of expressing, one or more genes of interest optionally located between one or more sets of restriction sites Gene expression cassettes as used herein typically comprise further regulatory sequences additional to the prompter to regulated the expression of the gene or genes within the open reading frame herein also indicated as coding region of the cassette.

In particular, in embodiments of the GVES herein described, the gene expression cassettes of the system comprise one or more gvp genes under control of regulatory sequence capable of operating in the mammalian host and are thus configured to provide a GV type in the mammalian cell.

The term "regulatory sequence" or "regulatory regions" as described herein indicate a segment of a nucleic acid molecule which is capable of increasing or decreasing transcription or translation of a gene within an organism either in vitro or in vivo. In particular, coding regions of the GV genes herein described comprise one or more protein coding regions which when transcribed and translated produce a polypeptide. Regulatory regions of a gene herein described comprise promoters, transcription factor binding sites, operators, activator binding sites, repressor binding sites, enhancers, protein-protein binding domains, RNA binding domains, DNA binding domains, silencers, insulators and additional regulatory regions that can alter gene expression in response to developmental and/or external stimuli as will be recognized by a person skilled in the art.

The term "operative connection" as used herein indicate an arrangement of elements in a combination enabling production of an appropriate effect. With respect to genes and regulatory sequences an operative connection indicates a configuration of the genes with respect to the regulatory sequence allowing the regulatory sequences to directly or indirectly increase or decrease transcription or translation of the genes.

Regulatory sequences used in gene expression cassettes herein described identified herein also as mammalian regulatory regions are configured to operate in a mammalian cell.

Exemplary regulatory regions capable of operating in mammalian cells comprise promoters, enhancers, silencers, terminators, regulators, operators, ribosome binding/entry sites, and riboswitches, among others known in the art. Regulatory regions capable of operating in a mammalian host can be selected by a skilled person following selection of the mammalian host of interest. Exemplary constitutive and inducible mammalian promoters and operators suitable for regulating expression of GVs in a mammalian host comprise and others identifiable by those skilled in the art and described herein.

Mammalian regulatory regions comprised in a gene expression cassette herein described, typically comprise a mammalian promoter, 5'UTR regions, 3'UTR regions, and a terminator as will be understood by a skilled person.

A "mammalian promoter" in the sense of the disclosure suitable for gene expression in a mammalian cell is a region of DNA that leads to initiation of transcription of a particular gene. Exemplary are typically located on a same strand and upstream on a DNA sequence (towards the 5' region of the sense strand), adjacent to the transcription start site of the genes whose transcription they initiate. In mammalian cells organisms, promoters typically comprise the eukaryotic TATA (SEQ ID NO:13) box. Promoters are located near the transcription start sties of genes, upstream on the DNA. Promoters can typically be about 100-1000 base pairs long. In particular promoters that can be used in gene expression cassette herein described can be a constitutive promoter or a conditional promoter.

The term "conditional promoter" refers to a promoter with activity regulatable or controlled by endogenous transcription factors or exogenous inputs such as chemical, or thermal inducers or optical induction. Examples of mammalian constitutive promoters include inducible promoters based on exogenous agents such as TET (tetracycline-response elements, TET-ON/TET-OFF), Lac, dCas-transactivator, Zinc-finger-TF, TALENs-ZF Gal4-uas, synNotch and inducible promoters based on endogenous signals TNF-alpha, cFOS and others identifiable to a skilled person.

The term "constitutive promoter" refers to an unregulated promoter that allows for continual transcription of its associated genes. Exemplary mammalian constitutive promoters that can be used for expression in mammalian cell include CMV from human cytomegalovirus, EF1a from human elongation factor 1 alpha, SV40 from the simian vacuolating virus 40, PGK1 from phosphoglycerate kinase gene, Ubc from human ubiquitin C gene, human beta actin, CAAG, Syn1 and others identifiable to those skilled in the art.

The wording "5'UTR region" refers to the region upstream from the initiation codon as will be understood by a person of ordinary skill in the art and is therefore outside the coding region of the cassette. The 5'UTR region can contain a Kozak sequence. The Kozak sequence used herein refers to a nucleic acid motif that functions as the protein translation initiation site in most eukaryotic mRNA transcripts as will be understood by a person skilled in the art. The Kozak sequence locates approximately 6 nucleotide sequence upstream of the ATG start codon. Exemplary Kozak sequence include GCCACCATG (SEQ ID NO: 475), TTCACCATG (SEQ ID NO: 476), (CCC)TTCACCATG (SEQ ID NO: 477) consensus sequence XXX[A/G]XXATG (SEQ ID NO: 478) wherein X indicates any nucleotide, and additional sequences identifiable by a skilled person.

The "3'UTR region" refers to an untranslated region that immediately follows the translation termination codon and is therefore outside the coding region of the cassette. 3'UTR region often contains regulatory regions that post-transcriptionally influence gene expression. Regulatory regions within the 3'UTR can influence polyadenylation, translation efficiency, localization, and stability of the mRNA as will be understood by a person skilled in the art. In some embodiments, the 3'UTR contains silencer regions which are configured to bind to repressor proteins and inhibit the expression of the mRNA.

A "terminator" as used herein indicates a sequence-based element that defines the end of a transcriptional unit and initiates the process of releasing the synthesized mRNA. Exemplary mammalian terminators include polyadenylation sites. A "polyadenylation site" indicates an element target by the polyadenylation enzymes such as CPSF and typically comprises the sequence AAUAAA (SEQ ID NO: 14) on the RNA. Polyadenylation sites will result in cleavage of the construct 10-30 nucleotides downstream the site, and addition of a poly(A) tail located at the end of 3'UTR as will be understood by a person skilled in the art. In gene expression cassette the poly(A) site can include SV40 polyadenylation element, hGH poly(A) signal, and other poly(A) signal that have the canonical AAUAAA (SEQ ID NO: 14) region as will be understood by a skilled person.

In some embodiments, a gene expression cassette can include additional mammalian regulatory regions configured to increase or decrease the expression of the GV coding regions of the cassette, as will also be understood by a skilled person.

Exemplary mammalian regulatory sequences increasing transcription of the operatively linked gene comprise enhancers that can be located more distally from the transcription start site compared to promoters, and either upstream or downstream from the regulated genes, as understood by those skilled in the art. Enhancers are typically short (50-1500 bp) regions of DNA that can be bound by transcriptional activators to increase transcription of a particular gene. Typically, enhancers can be located up to 1 Mbp away from the gene, upstream or downstream from the start site. An exemplary additional mammalian regulatory regions directed to enhance the expression levels of the GV genes, include Woodchuck Hepatitis Virus Posttranscriptional Regulatory Element (WPRE) placed downstream of the genes between GV gene and the poly(A) tail. The WPRE and WPRE-like (e.g. RE of Hepatitis B virus (HPRE)) element is known to increase transgene expression from a variety of viral vectors.

Exemplary mammalian regulatory sequences decreasing transcription of the operatively linked gene comprise RNAi/miRNA/shRNA sites that can be located upstream or downstream of the GV genes to control mRNA translation or degradation. For example, by binding to specific sites within the 3'UTR, miRNAs can decrease gene expression of various mRNAs by either inhibiting translation or directly causing degradation of the transcript.

Additional mammalian regulatory sequences that can be included in a gene expression cassette include post transcriptional regulatory sequences such as riboswitches typically present in eukaryotic untranslated regions (UTRs) of encoded RNAs. These sequences are configured to switch between alternative secondary structures in the RNA depending on the concentration of key metabolites. The secondary structures then either block or reveal other regulatory sequence regions such as RNA binding proteins. A further examples of additional post transcriptional regulatory sequences regulatory sequences comprise aptazymes fusions composed of an aptamer domain and a self-cleaving ribozyme which can be used for conditional gene expression to control mRNA levels with small molecules (e.g. tetracycline).

In general, selection of promoter and other regulatory sequences to be included in expression polynucleotidic constructs comprised in GVES of the present disclosure can be performed by one or more of the following: detecting functionality of a promoter and/or additional regulatory sequence in the host cells, selecting promoters and/or additional regulatory sequences known to be functional in the host cells; detecting the strength of the promoters and/or additional regulatory sequences in connection with protein production and/or selecting promoter and/or additional regulatory sequences of known strength; and selecting inducible promoters and/or additional regulatory sequence to control GV expression.

Mammalian regulatory sequences can be provided in any configuration which is directed to provide a desired expression of the GV protein in the coding regions. For example, a gene expression cassette can an end of UTR with polyA site only, or can be with WPRE and polyA site, or it can be with WPRE only. A combination of WPRE and polyA tail is expected to result in highest expression (highest copy of translated protein). Additional configuration can be identified by a skilled person.

In embodiments of the GVES herein described GV genes other than gvpA/B can be provided in a single gene expression cassette in various combinations and in any order to the extent that when the cassette comprises two or more gvp genes other than gvpA/B, the two or more gvp genes are configured to have each GV gene linked to another by a separation element.

A separation element used herein refers to an element that can be placed between two adjacent coding genes allowing for a separate transcription or translation of the two adjacent coding genes.

In some embodiments, a separation element can be an internal ribosome entry site ("IRES"). An internal ribosome entry site (IRES) used herein refers to an element that allows for translation initiation in a cap-independent manner. In some embodiments herein described, an IRES element is placed between two coding genes to allow for initiation of translation from an internal region of the mRNA. It allows the coordinated expression of two genes using the same promoter in a single gene cassette as will be understood by a person skilled in the art. Thus, the genes separated by IRES can be expressed from a bicistronic mRNA without requiring either cleavage of a polyprotein or generation of a monocistronic mRNA.

Internal ribosome entry sites are approximately 450 nucleotides in length and are characterized by moderate conservation of primary sequence and strong conservation of secondary structure. The most significant primary sequence feature of the IRES is a pyrimidine-rich site whose start is located approximately 25 nucleotides upstream of the 3' end of the IRES. Detailed information on IRES can be found in Jackson, et al., Trends Biochem. Sci., vol. 15, No. 12, pp. 477-483, 1990.

Examples of IRES known in the art include IRES obtainable from picornavirus and IRES obtainable from viral or cellular mRNA sources such as for example, immunoglobulin heavy-chain binding protein (BiP), the vascular endothelial growth factor (VEGF) (Huez et al. (1998) Mol. Cell. Biol. 18(11):6178-6190), the fibroblast growth factor 2 (FGF-2), and insulin-like growth factor (IGFII), the translational initiation factor eIF4G and yeast transcription factors TFIID and HAP4, the encephelomycarditis virus (EMCV) which is commercially available from Novagen (Duke et al. (1992) J. Virol 66(3):1602-9) and the VEG-FIRES (Huez et al. (1998) Mol Cell Biol 18(11):6178-90). IRES have also been reported in different viruses such as cardiovirus, rhinovirus, aphthovirus, HCV. Friend murine leukemia virus (FrMLV) and Moloney murine leukemia virus (MoMLV). As used herein, IRES encompasses functional variations of IRES sequences as long as the variation is able to promote direct internal ribosome entry to the initiation codon of a cistron.

In some embodiments, a separation element is a post-translation cleavage element comprising a cleavage site sequence. A post-translation cleavage element is typically placed between two adjacent coding genes.

In some embodiments, the post-translation cleavage element comprises a 2A element. The term "2A element" or "2A sequence" refers to a post-translational or co-translational processing cleavage site sequence. The 2A sequence can be a DNA sequence or the peptide expression produce of the DNA sequence. The latter is referred to as the 2A peptide. The 2A peptides are known to function by making the ribosome skip the synthesis of a peptide bond at the C-terminus of a 2A element, leading to separation between the end of the 2A sequence and the next peptide downstream. The cleavage occurs between the Glycine and Proline residues found on the C-terminus meaning the upstream cistron will have a few additional residues added to the end, while the downstream cistron will start with the Proline. The 2A elements used herein are placed between two adjacent GV coding genes. Exemplary 2A peptides are listed in Table 1 below:

TABLE 1

| Exemplary 2A peptide sequences | |
| --- | --- |
| P2A | ATNFSLLKQAGDVEENPGP (SEQ ID NO: 15) |
| T2A | EGRGSLLTCGDVEENPGP (SEQ ID NO: 16) |
| E2A | QCTNYALLKLAGDVESNPGP (SEQ ID NO: 17) |

TABLE 1-continued

| Exemplary 2A peptide sequences | |
| --- | --- |
| F2A | VKQTLNFDLLKLAGDVESNPGP (SEQ ID NO: 18) |
| BmCPV | DVFRSNYDLLKLCGDIESNPGP (SEQ ID NO: 19) |
| BmIFV | TLTRAKIEDELIRAGIESNPGP (SEQ ID NO: 20) |

In Table 1, the bold residues are the consensus residues among each type of 2A element (P2A, T2A, E2A or F2A). In each 2A element of Table 1, the cleavage occurs between the last G/P. In some embodiments, a linker sequence such as GAPGSG linker (SEQ ID NO: 21) is placed between a GV coding gene and the 2A sequence optionally using a linker, wherein any linker sequences such as GSG, GSGSG (SEQ ID NO: 2), SGS, and other linkers identifiable by a skilled person can be used. For example, a polynucleotide construct can comprise from 5' to 3' GV gene 1-GAPGSG-2A sequence-GV gene 2.

In some embodiments, the post-translation cleavage element comprises a cleavage recognition site that can be targeted and subsequently cleaved by protease enzymes. Exemplary protease enzymes include TEV, HCV NS3/5 protease, HIV protease, CMV protease, and HSV protease.

The term "protease cleavage site" in the sense of the disclosure indicates target sites for proteolytic cleavage by enzymes such as peptidases, proteases or proteolytic cleavage enzymes which break peptide bond between amino acids in proteins. The general nomenclature of cleavage site positions of the substrate were formulated by Schechter and Berger, 1967 [25] and Schechter and Berger, 1968 [26] Accordingly, the cleavage site is designated between P1-P1', incrementing the numbering in the N-terminal direction of the cleaved peptide bond (P2, P3, P4, etc.). On the carboxyl side of the cleavage site the numbering is incremented in the same way (P1', P2', P3' etc.).

Protease cleavage sites that can be inserted in engineered microcompartment proteins of the disclosure comprise regions up to 25 residues. In particular, protease cleavage sites are inserted in a configuration which makes them surface accessible. In some embodiments protease cleavage site are included in an unstructured segment or within an alpha helical or beta sheet secondary structured segment. Exemplary protease cleavage sites that can be inserted in engineered microcompartment proteins herein described comprise TEV protease cleavage sites with sequence ENLYFQG, (SEQ ID NO: 25) which is unstructured and others identifiable by a skilled person upon reading of the present disclosure (see Table 2).

Recognition sequences and cleavage sites of exemplary proteases are shown in Table 2. /forward slash (/) indicates where protease cleaves the protein sequence.

TABLE 2

Recognition sequences and cleavage sites of exemplary proteases

| Enzyme Name | Sequence and Cleavage | SEQ ID NO |
| --- | --- | --- |
| Human Rhinovirus (HRV) 3C Protease | LEVLFQ/GP | 22 |

TABLE 2-continued

Recognition sequences and cleavage sites of exemplary proteases

| Enzyme Name | Sequence and Cleavage | SEQ ID NO |
|---|---|---|
| Enterokinase | DDDDK/ | 23 |
| Factor Xa | IEGR/ | 24 |
| Tobacco etch virus protease (TEV protease) | ENLYFQ/G | 25 |
| Thrombin | LVPR/GS | 26 |
| NS3/4A | DLEVVT/STWV | 27 |
| NS4A/4B | DEMEEC/ASHL | 28 |
| NS4B/5A | DCSTPC/SGSW | 29 |
| NS5A/5B | EDVVCC/SMSY | 30 |
| NS4A/4B | DEMEEC/SQH | 31 |

In some embodiments, the cleavage recognition site comprises a TEV protease cleavable sequence that can be placed between two GV coding genes when the TEV enzymes are co-expressed. The TEV peptide can be cleaved to release the two GV proteins.

In some embodiments, the cleavage recognition site comprises a recognition sequence targeted by one or more non-structural protein NS3, NS4A, NS4B and NS5 sequence.

In some embodiments herein described, post-translation cleavage element comprises an intein or hedgehog family auto-processing domains or variants therefore, inserted in an open reading frame between multiple coding genes. The term "intein" refers to the protein equivalent of gene introns which facilitate protein splicing. The intein element contains the necessary components needed to catalyze protein slicing and often contains an endonuclease domain that participates in intein mobility (Perler, F. B., et al., Nucleic Acids Research 1994, 22, 1127).

The Hedgehog family auto-processing domains used herein comprise the hedgehog protein carboxy-terminal autocatalytic domain HhC. As a person skilled in the art will understand, the hedgehog ("Hh") proteins are composed of two domains, an amino-terminal domain HhN, which has the biological signal activity, and a carboxy-terminal autocatalytic domain HhC, a carboxy-terminal autocatalytic domain HhC which cleaves Hh into two parts in an intramolecular reaction and adds a cholesterol moiety to the HhN. HhC has sequence similarity to the self-splicing inteins, the shared region is termed Hint. New classes of proteins containing the Hint domain have been discovered in bacteria and eukaryotes.

As a person skilled in the art will understand, the sequences of the inserted auto-processing polypeptides or cleavage sites can be manipulated to enhance the efficiency of expression of the separate proteins.

Accordingly, in some embodiments, the constructs encoding gvpN, gvpF, gvpG, gvpL, gvpS, gvpK, gvpJ, and gvpU genes are comprised in a single polynucleotide. For example, all of the gvpN, gvpF, gvpG, gvpL, gvpS, gvpK, gvpJ, and gvpU genes can be provided in one open reading frame, operatively connected and under regulatory control of the same promoter. In an exemplary embodiments, gvpN, gvpF, gvpG, gvpL, gvpS, gvpK, gvpJ, and gvpU genes from B. megaterium are comprised in a single polycistronic construct (see e.g. construct of Example 8).

In some embodiments, the construct encoding gvpN, gvpF, gvpG, gvpL, gvpS, gvpK, gvpJ, and gvpU genes are comprised in more than one polynucleotide. For example, a subset of the gvpN, gvpF, gvpG, gvpL, gvpS, gvpK, gvpJ, and gvpU genes are comprised in one cassette in which they are, operatively connected and under regulatory control of a first promoter, whereas another subset of the gvpN, gvpF, gvpG, gvpL, gvpS, gvpK, gvpJ, and gvpU genes are comprised in another construct, operatively connected and under regulatory control of a second promoter. Each construct can be polycistronic construct when comprising two or more coding genes. For example, one subset of Ana gvpN, gvpJ, gvpK, gvpF, gvpG, gvpW, gvpV can be on a polynucleotide and another subset of Ana gvpN, gvpJ, gvpK, gvpF, gvpG, gvpW, gvpV can be on another construct, either as monocistronic constructs or as polycistronic constructs as will be understood by a skilled person.

The term "polycistronic construct" as used herein refers to a construct capable of simultaneously translating multiple genes from a single transcript as will be understood by a person skilled in the art, within a single cassette or in different cassettes on the construct if the cassettes are separated by an internal ribosome entry site.

In some embodiments, the polycistronic construct can be a biocistronic construct which comprises two genes separated by an Internal Ribosome Entry Site (IRES) element which allows for initiation of translation from an internal region of the mRNA. Use of IRES allows for the upstream protein to remain pristine while the downstream protein gets a MATT peptide addition to its N terminus. The second protein may be expressed at a lower level compared with the first protein since the ribosome entry site is less efficient than the 5' cap/UTR as will be understood by a skilled persons.

In some embodiments, some of the gene of a GVGC are expressed at a lower level compared to other gvp genes of the GV gene cluster when expressed under a same promoter and regulatory regions (herein also indicated as bottleneck genes). in those embodiments, the stoichiometry of the expression of the bottleneck genes can be increased to provide an optimal functionality of the GVES in the mammalian cell.

In particular, in some of those embodiments, the polynucleotide construct herein described further comprises a booster construct to elevate the gene expression. For example, the booster construct can contain gvp genes J, F, G, L and K connected with a separation element such as the p2A elements to elevate the expression of these genes. The booster construct containing gvp genes J, F, G, L and K can be comprised in one or more gene cassettes each operatively connected with regulatory sequences to enable the expression of the gvp genes J, F, G, L and K. In those embodiments when comprised in more than one operon, these genes are separated by a joint element such as the P2A element. In some embodiments, gvpJ and gvpK can also be used by themselves as boosters. gvpJ, F, G, L, K can also be on their own separate gene cassettes (e.g. on separate plasmids) and act as boosters.

In some embodiments the booster constructs can be comprised on one or more gene cassettes, where the use of promoter strengths can tune stoichiometry of the translated proteins. Stronger promoters can be used on the booster constructs while relatively weaker promoters can be used for the other cassette.

In some embodiments the booster constructs can be comprised on one or more gene cassettes, where the stability of the transcript can tune stoichiometry of the translated proteins. Regulatory elements that stabilize mRNAs (for example PolyA, WPRE) can be used on the booster constructs. For genes that need to be expressed at lower relative stoichiometries, these stability elements can be removed, or can be conditionally removed using siRNAs/shRNAs/aptazymes/cas9 and etc. While the other GV cassette can include these mRNA stability elements.

In some embodiments the booster constructs can be comprised on one or more gene cassettes, where the use of degradation tags can tune stoichiometry of the translated proteins. Degradation tags target proteins for proteolysis, for example ubiquitin and library of ubiquitin-fusion degradation tags (UbR, UbP, UbW, UbH, UbI, UbK, UbQ, UbV, UbL, UbD, UbN, UbG, UbY, UbT, UbS, UbF, UbA, UbC, UbE, UbM, 3xUbVR, 3xUbVV, 2xUbVR, 2xUbVV, UbAR, UbVV, UbVR, UbAV, 2xUbAR, 2xUbAV), auxin-inducible degraon (AID), D-element, the PEST sequence, unstructured initiation sites, or short sequences rich in acceptor lysines. Genes on the booster constructs will not have these degradation tags while relatively degradation tags can be used for the other genes that need to be expressed to lower levels. This can be used in combination with promoters and transcript stability examples.

Some embodiments the booster constructs can be comprised on one or more gene cassettes, where the use of micro-ORFs upstream of a cassette (ORF encoding gv genes) can be used to reduce the expression of GV proteins. Micro-ORFs are short open reading frames placed up stream of the ORF encoding the protein(s) of interest and results in the suppression of protein expression. They include a kozak/start codon NNNATG, small peptide and stop codon (TGA, TAG, TAA), for example AAAATGGCCGCGCCCAGAGCGTAG, NNNATG(NNN)[TAG/TGA/TAA] (SEQ ID NO: 474) ([27]). For genes that need to be expressed at lower relative stoichiometries, mico-ORFs can be placed upstream of their cassette to reduce the expression level of these GV proteins.

In some embodiments the booster constructs can be comprised on one or more gene cassettes, where the use of different inducible promoters (chemically or otherwise) can tune stoichiometry of translated proteins. Different promoters that are inducible by different stimuli can be used to drive expression of the booster construct and/or other cassettes. A higher amount of inducer can be used to increase the expression of booster constructs. For genes that need to be expressed at lower relative stoichiometries a relatively lower amount of inducer can be used.

In some embodiments the booster constructs can be comprised on one or more gene cassettes, where the presence of enhancing introns can tune stoichiometry of the translated proteins. Intron-mediated enhancement can be used on the booster constructs. For genes that need to be expressed at lower relative stoichiometries, these introns can be omitted, while the other GV cassette can include these introns. ([28], [29])

In some embodiments the booster constructs can be comprised on one or more gene cassettes, where the stoichiometry of the translated proteins can be tuned by different modes of Ribosome entry. Translation of the booster construct can be initiated via the stronger cap-dependent gene expression mediated by the KOZAK sequence and genes that need to be expressed at lower relative stoichiometries can be initiated via Internal Ribosome Entry Site (IRES).

Accordingly, in some of these embodiments, the GVES of the disclosure the polynucleotides comprises at least three cassettes possibly on three different polynucleotides, wherein the first polynucleotide contains gas vesicle gene B, the second polynucleotide is the booster construct containing gas vesicle genes J, F, G, L and K connected with a separation element, and at least a third polynucleotide contains the gas vesicle gene N, F, G, L, S, K, J, and U (gvpN, gvpF, gvpG, gvpL, gvpS, gvpK, gvpJ, and gvpU). These gas vesicle genes N, G, L, S, K, J, and U can be comprised in one or more synthetic operons each operatively connected with regulatory sequences to enable the expression of the gas vesicle genes N, F, G, L, S, K, J, and U. When comprised in more than one gene expressions cassette, these genes are separated by a separation element such as the P2A element. In embodiments here described the order of gvp genes within one or more cassettes are not important to determine functionality of the system. The co-transfection of these at least three polynucleotides is sufficient for robust expression of gas vesicles in cells, herein referred to as mammalian acoustic reporter gene (mammalian ARG) (see Examples 12 and 13). Additionally, this architecture can be further consolidated by connecting the gas vesicle protein B gene to the polycistronic construct using IRES. When this new architecture is co-transfected to cells with the booster plasmid, it robustly produces gas vesicles.

In some embodiments, the GVES can comprise one cassette that encodes gvpB, one cassette that encodes gvpN, gvpF, gvpG, gvpL, gvpS, gvpK, gvpJ, and gvpU, and a booster with gvpJ, F, G, L, K as a polycistronic cassette and/or as a plurality of monocistronic cassettes. The cassettes can be on separate polynucleotides or on one or more polynucleotides. For example the GVPB cassette can be comprised on a same polynucleotide construct together with the cassette comprising gvpN, gvpF, gvpG, gvpL, gvpS, gvpK, gvpJ, and gvpU, or on a same polynucleotide with one booster cassette comprising gvpJ, F, G, L (see e.g. construct of Example 8).

Additional embodiments with other GVGC clusters e.g. comprising gvp genes from *B. megaterium* and/or genes form *Anabaena flos-aquae* as well as additional clusters are identifiable by a skilled person upon reading of the present disclosure.

In embodiments herein described, the GVES comprising a GVGC in two or more gene cassettes located on one or more polynucleotide construct herein described operatively connected to regulatory sequences can be introduced to a mammalian host allowing expression of the GV constructs and producing of gas vesicles in the mammalian host.

In particular in some embodiments, the method comprises introducing into the mammalian cell a genetically engineered Gas Vesicle expression system (GVES) herein described for a time and under condition to allow expression of the gvp genes in the mammalian cell.

In some embodiments, the method comprises introducing into a cell of the mammalian host a genetically engineered Gas Vesicle expression system (GVES) herein described in which the gvp genes encode for proteins of the gas vesicle type, the introducing performed for a time and under condition to allow expression of the gvp genes in the mammalian cell.

Expression of GV constructs in a mammalian cell can be performed by cloning one or more polynucleotides encoding naturally occurring GV proteins or homologs thereof that are required for production of GVs (comprising gvpB, gvpN, gvpF, gvpG, gvpL, gvpS, gvpK, gvpJ, and gvpU and other proteins known to those skilled in the art and described herein) into one or more suitable constructs configured to express the heterologous GV proteins in the mammalian cell. Polynucleotides encoding GV protein genes can be cloned using commercially available reagents from vendors such as Qiagen, Invitrogen, Applied Biosystems, Promega, New England BioLabs and others, following standard molecular biology methods known in the art, such as those described herein. As would be understood by those skilled in the art, polynucleotides encoding GV protein genes can be obtained from several different sources. For example, polynucleotides encoding GV proteins can be obtained by isolating genomic DNA or cDNA encoding GV proteins from microorganisms whose genomes encode GV proteins genes, and/or express GV proteins RNA. RNA can be isolated from a cell that expresses GV proteins genes, and cDNA produced by reverse transcription using standard techniques and commercial kits. Genomic DNA can be purified from the cell, and cDNA or genomic DNA encoding one or more GV proteins isolated, following methods known to those in the art. In addition or in the alternative, polynucleotides comprising one or more gas vesicle genes can be synthesized using oligonucleotide and polynucleotide synthetic methods known in the art. For example, if rare mammalian codons are identified following purification of genomic DNA from the cell, rare mammalian codons are preferably edited to improve expression in the target cell. PCR-based amplification of one or more GV protein genes can be performed using appropriately designed primer pairs (e.g. using PrimerDesign or other programs known to those skilled in the art). PCR-based amplification can be followed by ligation (e.g. using T4 DNA ligase) of a polynucleotide encoding gas vesicle gene amplicon into an appropriate construct in a plasmid suitable for propagation in bacteria or archaea, such as transformation-competent E. coli DH5alpha or other competent E Coli type, followed by growth of transformed cell cultures, purification of the plasmid for confirmation of the cloned gene by DNA sequence analysis, among other methods known to those skilled in the art. Expression vectors can comprise plasmid DNA, viral vectors, or non-viral vectors, among others known to those skilled in the art, comprising appropriate regulatory elements such as promoters, enhancers, and post-transcriptional and post-translational regulatory sequences that are compatible with the mammalian cell intended to heterologously express the GV, as would be understood by a skilled person. In particular, in embodiments described herein, expression vectors suitable for regulating heterologous expression of GVs comprise those having promoters and other regulatory elements known to skilled persons that are compatible with mammalian cells, including cell lines, primary cells cultured in vitro such as petri dishes or introduce the GV gene circuits inside the animal to genetically engineer cells directly inside the animal and described above. Promoters can be constitutively active or inducible (and chosen to be selectively expressed in different cell types). Exemplary inducible expression systems comprise tetracycline-inducible expression as shown in Examples 13, and 18.

In particular, in some embodiments described herein, production of a GV gene sequences can be codon-optimized (for example to remove rare mammalian codons) for expression in the mammalian cell type according to methods identifiable by a skilled person. As would be understood by those skilled in the art, the term "codon optimization" as used herein refers to the introduction of synonymous mutations into codons of a protein-coding gene in order to improve protein expression in expression systems of a particular organism, such as human, in accordance with the codon usage bias of that organism. The term "codon usage bias" refers to differences in the frequency of occurrence of synonymous codons in coding DNA. The genetic codes of different organisms are often biased towards using one of the several codons that encode a given amino acid over others, and use the one codon with a greater frequency than expected by chance. Optimized codons in organisms reflect the composition of their respective genomic tRNA pool. The use of optimized codons can help to achieve faster translation rates and high accuracy (and ultimately higher recombinant protein yield).

In some embodiments, one or more statistical methods proposed and used to analyze codon usage bias the field of bioinformatics and computational biology can be used for codon optimization in the sense of the disclosure. Methods such as the 'frequency of optimal codons' (Fop), the Relative Codon Adaptation (RCA) or the 'Codon Adaptation Index' (CAI) are used to predict gene expression levels, while methods such as the 'effective number of codons' (Nc) and Shannon entropy from information theory are used to measure codon usage evenness. Multivariate statistical methods, such as correspondence analysis and principal component analysis, are widely used to analyze variations in codon usage among genes. There are many computer programs to implement the statistical analyses enumerated above, including CodonW, GCUA, INCA, and others identifiable by those skilled in the art. Several software packages are available online for codon optimization of gene sequences, including those offered by companies such as GenScript, EnCor Biotechnology, Integrated DNA Technologies, ThermoFisher Scientific, among others known those skilled in the art. Those packages can be used in providing GV proteins with codon usage ensuring optimized expression in various prokaryotic cell systems as will be understood by a skilled person. In particular, codon optimization in embodiments herein described can be used primarily to remove or limit the use of rare codons, or keep codon usage above ~10%)

Mammalian cell used herein to include a GVES of the disclosure refers to a mammalian cell which can be transduced, infected, transfected or transformed with a vector under certain culture conditions. The vector can be plasmid, a viral particle, or others identifiable to a person skilled in the art. The term mammalian cell refers to cells isolated from an animal (mammal) tissue and expanded in culture for use as therapeutic and research tools.

In some embodiments, the transformed mammalian cells can comprise one or more cells such as T-cells, hematopoietic stem cells, mesenchymal stem cells, neural precursor cells, macrophages, fibroblasts or cardiomyocytes and any cell where one can express reporter genes (e.g. Green fluorescent protein (GFP)).

In some embodiments, the transformed mammalian cells can be part of a tissue in vivo or ex vivo.

In some embodiments, the transformed mammalian cells can be isolated mammalian cells such as mammalian cell lines. Mammalian cell lines used herein refer to human or non-human mammalian recombinant expression systems capable of producing post-translational modifications which closely resemble those in mammalian cells in vivo. Exemplary non-human mammalian cell lines include CHO-K1, mouse myeloma cell lines such as NS0, SP2/0, rat myeloma cell lines such as YB2/0, baby hamster kidney (BHK), N2A cells, HeLa, Jurkat, NIH3T3, and others identifiable to a person skilled in the art. Human mammalian cell lines are immortalized cells propagated in vitro from primary explants of human tissue or body fluid. Exemplary human cell lines include HEK293 and its derivatives, HT-1080, PER.C6, Huh-7 as well as others identifiable to a person skilled in the art.

In some embodiments, the transformation can occur in an individual of a mammalian species such as *Homo sapiens* or *Mus musculus*, for example, among others. In some embodiments, mammalian cells in the sense of the disclosure comprise stem cells, progenitor cells, induced pluripotent stem cells, and others identifiable by a skilled person.

In some embodiments herein described, the GVES herein described can be introduced in a mammalian cell to provide a reportable molecular component (herein GVRMC) of a gas vesicle reporting (GVR) genetic circuit in operative connection with other molecular components of the genetic circuit to report occurrence of a biochemical event in the mammalian cell.

The term "molecular component" as used in connection with the GVR genetic circuits described herein indicates a chemical compound or a structure comprised of a plurality of chemical compounds comprised in a cellular environment. Exemplary molecular components thus comprise polynucleotides, such as ribonucleic acids or deoxyribonucleic acids, polypeptides, polysaccharides, lipids, amino acids, peptides, sugars and/or other small or large molecules and/or polymers that can be found in a cellular environment. In some embodiments described herein, a molecular component of a GVR genetic circuit is a GV type or a cluster thereof.

The term "genetic molecular component" as used herein indicates a molecular unit formed by a gene (possibly comprising or formed by a cluster of genes), an RNA transcribed from the gene or a portion thereof and optionally a polypeptide or a protein translated from the transcribed RNA. In genetic circuits herein described, the biochemical reactions connecting the genetic molecular component to another molecular component of the circuit can involve any one of the gene, the transcribed RNA and/or the polypeptide forming the molecular component.

A gene comprised in a genetic molecular component is a polynucleotide that can be transcribed to provide an RNA and typically comprises coding regions as well as one or more regulatory sequence regions, which is a segment of a nucleic acid molecule which is capable of increasing or decreasing transcription or translation of the gene within an organism either in vitro or in vivo. In particular, coding regions of a gene herein described can comprise one or more protein coding regions which when transcribed and translated produce a polypeptide, or if an RNA is the final product only a functional RNA sequence that is not meant to be translated. Regulatory regions of a gene herein described comprise promoters, transcription factor binding sites, operators, activator binding sites, repressor binding sites, enhancers, protein-protein binding domains, RNA binding domains, DNA binding domains, silencers, insulators and additional regulatory regions that can alter gene expression in response to stimuli as will be recognized by a person skilled in the art.

An RNA of a genetic molecular component comprises any RNA that can be transcribed from a gene, such as a messenger ribonucleic acid (mRNA), short interfering ribonucleic acid, or ribonucleic acid capable of acting as a regulating factor in the cell. mRNA comprised in a genetic molecular component comprises regions coding for the protein as well as regulatory regions. mRNA can have additional control elements encoded, such as riboregulator sequences or a protein binding aptamer sequence placed upstream of the gene so the protein blocks ribosomes and conditionally prevents translation. Other RNAs that serve regulatory roles that can comprise the genetic molecular component include riboswitches, aptamers (e.g. malachite green, Spinach), aptazymes, guide CRISPR RNAs, and other RNAs known to those skilled in the art.

A protein comprised in a molecular component can be proteins with activating, inhibiting, binding, converting, or reporting functions. Proteins that have activating or inhibiting functions typically act on operator sites encoded on DNA, but can also act on other molecular components. Proteins that have binding functions typically act on other proteins, but can also act on other molecular components. Proteins that have converting functions typically act on small molecules, and convert small molecules from one small molecule to another by conducting a chemical or enzymatic reaction. Proteins with converting functions can also act on other molecular components. Proteins with reporting functions have the ability to be easily detectable by commonly used detection methods (absorbance, fluorescence, for example), or otherwise cause a reaction on another molecular component that causes easy detection by a secondary assay (e.g. adjusts the level of a metabolite that can then be assayed for). The activating, inhibiting binding, converting, or reporting functions of a protein typically form the interactions between genetic components of a genetic circuit. Exemplary proteins that can be comprised in a genetic molecular component comprise monomeric proteins and multimeric proteins, proteins with tertiary or quaternary structure, proteins with linkers, proteins with non-natural amino acids, proteins with different binding domains, and other proteins known to those skilled in the art.

The term "cellular molecular component" indicates a molecular component not encoded by a gene, or indicates a molecular component transcribed and/or translated by a gene but comprised in the circuit without the corresponding gene. Exemplary cellular components comprise polynucleotides, polypeptides, polysaccharides, small molecules and additional chemical compounds that are present in a cellular environment and are identifiable by a skilled person. Polysaccharides, small molecules, and additional chemical compounds can include, for example, NAD, FAD, ATP, GTP, CTP, TTP, AMP, GMP, ADP, GDP, Vitamin B 1, B12, citric acid, glucose, pyruvate, 3-phosphoglyceric acid, phosphoenolpyruvate, amino acids, PEG-8000, FiColl 400, spermidine, DTT, b-mercaptoethanol maltose, maltodextrin, fructose, HEPES, Tris-Cl, acetic acid, aTc, IPTG, 3OC12HSL, 3OC6HSL, vanillin, malachite green, Spinach, succinate, tryptophan, and others known to those skilled in the art. Polynucleotides can include RNA regulatory factors (small activating RNA, small interfering RNA), or "junk" decoy DNA that either saturates DNA-binding enzymes (such as exonuclease) or contains operator sites to sequester activator or repressor enzymes present in the system. Polypeptides can include those present in the genetic circuit but not produced by genetic components in the circuit, or those added to affect the molecular components of the circuit.

In embodiments of genetic circuits herein described, one or more molecular components is a recombinant molecular component that can be provided by genetic recombination (such as molecular cloning) and/or chemical synthesis to bring together molecules or related portions from multiple sources, thus creating molecular components that would not otherwise be found in a single source.

In a GVRMC of the disclosure, at least one gene expression cassette of the gene expression cassettes of the GVES of the disclosure comprises a gas vesicle reporting (GVR) target region configured to be activated and/or inhibited by a molecular component of a genetic circuit.

These additional (GVR) target region can include genetic elements that allow control over cellular behavior through various biochemical processes including transcriptional control, translational control, post-translational control and other control processes identifiable to a person skilled in the art.

In some embodiments, the transcriptional control elements can include constitutive promoters, repressor and/or activator sites, recombination sites, inducible and/or tissue-specific promoters, or cell fate regulators. The translational control elements can include RNAi, Riboregulators, RNA secondary structural motifs included in the GVES mRNA, or Ribosome-binding sites. The post-translational control elements can include elements controlling phosphorylation cascades, protein receptor design, protein degradation element, and localization signals. Examples of these regulatory regions and their functional purposes can be found in published review articles such as Purnick et al. ([30]) (for example Table 1 of Purnick) as will be understood by a person skilled in the art.

In embodiments herein described, a genetic circuit comprises at least one genetic molecular component or at least two genetic molecular components, and possibly one or more cellular molecular components, connected one to another in accordance with a circuit design by activating, inhibiting, binding or converting reactions to form a fully connected network of interacting components.

In embodiments of the GVR genetic circuits described herein, the molecular components are connected with one another according to a circuit design in which a molecular component is an input and another molecular component is an output. In particular, a genetic circuit typically has one or more input or start molecular component which activates, inhibits, binds and/or convert another molecular component, one or more output or end molecular component which are activated, inhibited, bound and/or converted by another molecular component, and intermediary molecular components each inhibiting, binding and/or converting another molecular component and being activated, inhibited, bound and/or converted by another molecular component. In some embodiments of the genetic circuits herein described, the input is the biochemical event and/or a trigger molecular component and the output is activation of expression of a GV gene cluster and assembly of a GV type through binding reactions between gvps of the GV type. In other embodiments of the genetic circuits herein described, the input is a biochemical event and/or a trigger molecular component and the output is an intracellular spatial translocation of the GV type, the intracellular spatial translocation occurring typically through one or more converting and/or binding reactions as described herein. The output of GVR circuit herein described can be detected with ultrasound contrast, MRI SWI, light scattering and additional techniques to detect GV identifiable by a skilled person upon reading of the present disclosure.

The term "activating" as used herein in connection with a molecular component of a genetic circuit refers to a reaction involving the molecular component which results in an increased presence of the molecular component in the cellular environment. For example, activation of a genetic molecular component indicates one or more reactions involving the gene, RNA and/or protein of the genetic molecular component resulting in an increased presence of the gene, RNA and/or protein of the genetic molecular component (e.g. by increased expression of the gene of the molecular component, and/or an increased translation of the RNA). An example of "activating" described herein comprises the initiation of expression of a GV gene cluster under the control of the tetracycline-inducible promoter (using reverse tetracycline-controlled transactivator) followed by the ultrasound response of mammalian ARGs (e.g., see Example 13, and 18).

Activation of a molecular component of a genetic circuit by another molecular component of the circuit can be performed by direct or indirect reaction of the molecular components. Examples of a direct activation of a genetic molecular component comprise in a circuit the production of an alternate sigma factor (molecular component of the circuit) that drives the expression of a gene controlled by the alternate sigma factor promoter (other molecular component of the circuit), or the production of a small ribonucleic acid (molecular component of the circuit) that increases expression of a riboregulator-controlled RNA (molecular component of the circuit). Examples of indirect activation of a genetic molecular component comprise the production of a first protein that inhibits an intermediate transcriptional repressor protein, wherein the intermediate transcriptional repressor protein represses the production of a target gene, such that the first protein indirectly activates expression of the target gene.

The term "inhibiting" as used herein in connection with a molecular component of a genetic circuit refers to a reaction involving the molecular component of the genetic circuit and resulting in a decreased presence of the molecular component in the cellular environment. For example, inhibition of a genetic molecular component indicates one or more reactions involving the gene, RNA and/or protein of the genetic molecular component resulting in a decreased presence of the gene, RNA and/or protein (e.g. by decreased expression of the gene of the molecular component, and/or a decreased translation of the RNA). Inhibition of a cellular molecular component indicates one or more reactions resulting in a decreased production or increased conversion, sequestration or degradation of the cellular molecular components (e.g. a polysaccharide or a metabolite) in the cellular environment.

Inhibition can be performed in the genetic circuit by direct reaction of a molecular component of the genetic circuit with another molecular component of the circuit or indirectly by reaction of products of a reaction of the molecular components of the genetic circuit with the another molecular component of the circuit.

The term "binding" as used herein in connection with molecular components of a genetic circuit refers to the connecting or uniting two or more molecular components of the circuit by a bond, link, force or tie in order to keep two or more molecular components together, which encompasses either direct or indirect binding where, for example, a first molecular component is directly bound to a second molecular component, or one or more intermediate molecules are disposed between the first molecular component and the second molecular component another molecular component of the circuit. Exemplary bonds comprise covalent bond, ionic bond, van der Waals interactions and other bonds identifiable by a skilled person.

In some embodiments, the binding can be direct, such as the production of a polypeptide scaffold that directly binds to a scaffold-binding element of a protein. In other embodiments, the binding may be indirect, such as the co-localization of multiple protein elements on one scaffold. In some instances binding of a molecular component with another molecular component can result in sequestering the molecular component, thus providing a type of inhibition of said molecular component. In some instances, binding of a molecular component with another molecular component can change the activity or function of the molecular component, as in the case of allosteric interactions between proteins, thus providing a type of activation or inhibition of the bound component.

The term "converting" as used herein in connection with a molecular component of the circuit refers to the direct or indirect conversion of the molecular component into another molecular component. An example of this is the conversion of chemical X by protein A to chemical Y that is then further converted by protein B to chemical Z.

In the GVR genetic circuits in the sense of the present disclosure, the gvp genes and related cassettes included with a GVES of the disclosure are introduced into a mammalian cell to provide a reportable molecular component connected with other genetic or cellular molecular components according to a circuit design, wherein the GV type is expressed or the GV type is intracellularly spatially translocated when the GVGC genetic circuit operates according to the circuit design in response to a biochemical event and/or to a trigger molecular component.

The term "reportable molecular component" as used herein indicates a molecular component capable of detection in one or more systems and/or environments. The terms "detect" or "detection" as used herein indicates the determination of the existence, presence or fact of a target in a limited portion of space, including but not limited to a sample, a reaction mixture, a molecular complex and a substrate. The "detect" or "detection" as used herein can comprise determination of chemical and/or biological properties of the target, comprising ability to interact, and in particular bind other compounds, ability to activate another compound and additional properties identifiable by a skilled person upon reading of the present disclosure. The detection can be quantitative or qualitative. A detection is "quantitative" when it refers, relates to, or involves the measurement of quantity or amount of the target or signal (also referred as quantitation), which includes but is not limited to any analysis designed to determine the amounts or proportions of the target or signal. A detection is "qualitative" when it refers, relates to, or involves identification of a quality or kind of the target or signal in terms of relative abundance to another target or signal, which is not quantified. In particular, in embodiments herein described detection of the reportable molecular component comprising a GV type is performed through contrast enhanced imaging techniques such as ultrasound and MRI (and light scattering).

The term "biochemical event" as used herein refers to an activating, inhibiting, binding or converting reaction between two or more molecular components within a prokaryotic cell.

Accordingly, in some embodiments, at least one genetic molecular component of the GVR genetic circuit comprises a GVB cassette and additional GVP cassettes of the GVES of the disclosure comprising genes gvpB gene gvpN, gvpF, gvpG, gvpL, gvpS, gvpK, gvpJ, and gvpU genes, in a gas vesicle (GV) gene cluster in which the GV genes are operatively connected to a promoter configured to be activated directly or indirectly by the biochemical event, and directly initiate expression of a GV type.

In some embodiments herein described, a genetic molecular component of the GVR genetic circuit comprises a gas vesicle (GV) gene cluster comprising the GVB cassette and additional GVP cassettes of the GVES of the disclosure in which genes gvpB gene gvpN, gvpF, gvpG, gvpL, gvpS, gvpK, gvpJ, and gvpU genes are configured to be activated directly or indirectly by the biochemical event, and directly initiate expression of a GV type through interactions with promoters as well as one or more enhancers and/or other regulatory DNA elements comprised within the GVB and/or additional GVP cassettes, which are identifiable by those skilled in the art. As would be understood by those skilled in the art, promoters are DNA regulatory elements that are typically located adjacent to the transcription start sites of genes, or a cluster of genes, on the same strand and upstream on a DNA sequence (towards the 5' region of the sense strand), and for transcription to occur, the enzyme that synthesizes RNA, known as RNA polymerase, attaches to the promoter. Promoters contain DNA sequences identifiable by those skilled in the art, such as those that provide binding sites for RNA polymerase and also for proteins that function as transcription regulatory factors that can either activate or repress gene transcription.

The term "transcription regulatory factor" or "transcription factor" as used herein refers to any type of factors that can function by acting on a regulatory DNA element such as a promoter or enhancer sequence. The transcription regulatory factors can be broadly classified into a transcription repression factor (also referred to as "repressor") and a transcription activation factor (also referred to as "activator"). The transcription repression factor acts on a regulatory DNA element to repress the transcription of a gene, thereby reducing the expression level of the gene. The transcription activation factor acts on a regulatory DNA element to promote the transcription of a gene, thereby increasing the expression level of the gene.

In particular, a transcription regulatory factor has typically at least one DNA-binding domain that can bind to a specific sequence of enhancer or promoter sequences. Some transcription factors bind to a DNA promoter sequence near the transcription start site and help form the transcription initiation complex. Other transcription factors bind to other regulatory sequences, such as enhancer sequences, and can either stimulate or repress transcription of the related gene.

Examples of specific transcription repression factors include KRAB, repressor domains of proteins Egr-1, Oct2A, Dr1, YY1, RE-1 silencing transcription factor (REST), Retinoblastoma protein, and MeCP2, mSin interaction domain, TALE repressors), and other identifiable by a skilled person, as well as homologues of known repression factors, that function in both prokaryotic and eukaryotic systems. Examples of transcription activation factors include (VP-16, VP-64, etc.) as well as homologues of known activation factors, that function in eukaryotic systems.

In some embodiments, one or more promoters operatively connected to one or more GVGC genes comprised within the GVB cassette and additional GVP cassettes of the GVES of the disclosure can be configured to be activated directly or indirectly by one or more biochemical events. In particular, in some embodiments, activation of expression of a GV genes introduced in a mammalian cell, can be linked to another molecular component in the GVR genetic circuit through activator or repressor transcription factors. In some embodiments, expression of the transcription factors can be regulated by a promoter of interest (see Examples section). In other embodiments, transcription factors can be regulated post-translationally through degradation or phosphorylation of the transcription factor.

Accordingly, the reportable genetic molecular component of the GVR genetic circuit comprising the GVB cassette and additional GVP cassettes of the GVES of the disclosure in which genes gvpB gene gvpN, gvpF, gvpG, gvpL, gvpS, gvpK, gvpJ, and gvpU genes are operatively connected to a promoter configured to be activated directly or indirectly by the biochemical event, and directly initiate expression of a GV type can in several embodiments comprise promoters and/or other DNA regulatory elements having one or more sequences identifiable to those skilled in the art that are configured to function as binding sites for any known transcription regulatory factor.

For example, in some embodiments GV genes expression in GVR circuit of the disclosure can be activated by promoters inducible by sugars (e.g., L-arabinose, L-rhamnose, xylose and sucrose), antibiotics (e.g., tetracycline), CRISPR-dCas9 (possibly in conjunction with conditionally active gRNAs), heat shock promoters, pH-dependent promoters, oxidation stress-dependent promoters, radiation-dependent promoters, metal-inducible promoters, inflammation factor-inducible promoters, signaling factor-inducible promoter and others identifiable by those skilled in the art. In other embodiments GV genes expression can be induced by activation of constitutive promoters of varying strengths that are suitable for regulating expression in mammalian cells described herein and identifiable by those skilled in the art.

In other embodiments, the GV gene or one or more of the regulatory elements of GVR circuit of the disclosure, is surrounded by recombination sites that are recognized by a recombinase, whose expression or activity is connected through the genetic circuit to a biochemical event in the bacterial cell. For example, a GV genes introduced in the mammalian cell in reverse (3'-5') orientation to its promoter (in 5'-3' orientation) can be flanked by recombination sites surrounding the GV genes, with the recombination sites configured to allow inversion of the hybrid GV gene cluster upon expression or activation of its respective recombinase, wherein upon recombination the hybrid GV gene is flipped into a 5'-3' orientation to allow initiation of expression by the promoter. Suitable recombination systems for use in mammalian cells are identifiable by those skilled in the art, such as the piggy-bac integrase system, phiC31 and Bxb1 integrases, and the FLP/FRT or Cre/lox recombination systems, and additional systems identifiable by a skilled person.

In embodiments described herein, a GV gene cluster introduced by the GVES of the disclosure comprised in one or more genetic molecular components of the GVR genetic circuits described herein is configured to function as a set of reporter genes, which together encode proteins required for the formation of a GV type, such that expression of the GV type functions as a genetically-encoded reporter of the biochemical event in the mammalian cell comprising a GVR genetic circuit. As described herein, the reportable characteristics of the GV are such that the genetically-encoded GV can be used as a contrast agent, which, when used together with one or more contrast-enhanced imaging techniques described herein, functions as a genetically-encoded reporter in prokaryotic cells that have been genetically engineered to comprise one or more of the GVR genetic circuits described herein.

In particular, in exemplary embodiments described herein, all the GV genes of the cluster (e.g. gvpF, gvpG, gvpJ, gvpL, gvpK, gvpS, and gvpU and gvpA) enable GV formation. Therefore, if expression any one of these genes is regulated according to the design of a GVR genetic circuit as described herein then the expression of the GV type will be regulated accordingly.

In some embodiments, the GVR genetic circuits described herein can comprise a plurality of genetic molecular components that function as Boolean logical operators in genetic circuit designs known to those skilled in the art, such as those described in [31, 32]. As would be understood by persons skilled in the art, Boolean logic is a branch of algebra in which the values of the variables are the truth values 'true' and 'false', usually denoted by the digital logic terms and '0' respectively. In contrast with elementary algebra where the values of the variables are numbers, and the main operations are addition and multiplication, the main operations of Boolean logic are the conjunction 'AND', the disjunction 'OR', and the negation 'NOT'. As understood by those skilled in the art, it is thus a formalism for describing logical relations in the same way that ordinary algebra describes numeric relations.

Accordingly, the term "AND gate" refers to a digital logic gate that behaves according to the truth table shown in Table 3. A 'true' output (1) results only if both the inputs to the AND gate are 'true' (1). If neither or only one input to the AND gate is 'true' (1), a 'false' (0) output results. Therefore, the output is always 0 except when all the inputs are 1.

TABLE 3

'AND gate' truth table:

| Input | | Output |
|---|---|---|
| A | B | A AND B |
| 0 | 0 | 0 |
| 0 | 1 | 0 |
| 1 | 0 | 0 |
| 1 | 1 | 1 |

In particular, the term "AND gate" as used herein refers to the logical relation between two genetic molecular components in a GVR genetic circuit, wherein inputs 'A' and 'B' in Table 3 are two biochemical events, and the output 'A AND B' in Table 3 is the production of a certain GV type.

For example, in some embodiments of an "AND gate" comprised in a GVR genetic circuit described herein, the GVR genetic circuit comprises a plurality of genetic molecular components wherein at least a first genetic molecular component comprises a first subset of genes from the GV gene cluster, and at least a second genetic molecular component comprises a second subset of genes from the GV gene cluster, wherein together the GV proteins expressed from the first and second genetic molecular components are configured to form a GV type. In these embodiments, activation of both the first AND second genetic molecular component is required for the output of the GV type in the genetic circuit when the genetic circuit operates according to the design of the genetic circuit. For example, the first and second genetic molecular components can comprise promoters that are activated by two or more biochemical events in the mammalian cell comprising the GVR genetic circuit.

In exemplary embodiments, any of gvpN, gvpF, gvpG, gvpJ, gvpL, gvpK, gvpS, and gvpU and gvpA of a GV gene cluster formed by genes gvpB gene gvpN, gvpF, gvpG, gvpL, gvpS, gvpK, gvpJ, and gvpU genes within the GVB cassette and additional GVP cassettes of the GVES of the disclosure can be split into at least a first and second genetic molecular component comprising at least a first and a second subset of these genes to form an AND gate.

In other embodiments of an "AND gate" comprised in a GVGC genetic circuit, two or more regulatory elements operatively connected to a GV gene cluster comprised in a genetic molecular component of a GVGC genetic circuit that is activated by biochemical events A AND B would result in the output of the GV type in the GVGC genetic circuit. For example, the promoter requires binding of two transcriptional activators for activation of the promoter. In Examples described herein (see the Methods section of the Examples), GV gene clusters of exemplary ARG1 and ARG2 and A2C constructs is driven by the T7 promoter that has a lac operator downstream of the promoter. The T7 RNA Polymerase is regulated by the araBAD promoter (inducible by L-arabinose). The lac operator is repressed by LacI (IPTG derepresses). Therefore only under conditions wherein both IPTG AND L-ara are present are GVs expressed.

The term "OR gate" refers to a digital logic gate that behaves according to the truth table shown in Table 4. A 'true' output (1) results if either of the inputs to the OR gate are 'true' (1).

TABLE 4

'OR gate' truth table:

| Input | | Output |
|---|---|---|
| A | B | A OR B |
| 0 | 0 | 0 |
| 0 | 1 | 1 |
| 1 | 0 | 1 |
| 1 | 1 | 1 |

In particular, the term "OR gate" as used herein refers to the logical relation between two genetic molecular components in a GVGC genetic circuit, wherein inputs 'A' and 'B' in Table 3 are two biochemical events, and the output 'A OR B' in Table 3 is the production of a certain GV type.

For example, in some embodiments of an "OR gate" comprised in a GVGC genetic circuit described herein, a promoter operatively connected to a GV gene cluster comprised in a genetic molecular component of a GVGC genetic circuit that is activated by biochemical events A OR B would result in the output of the GV type in the GVGC genetic circuit. For example, the promoter is activated by binding of either of two different transcriptional activators.

In other embodiments, an OR gate can be achieved through the use of two consecutive promoters. In exemplary embodiments, both these promoters can be located directly upstream of the GV gene cluster or they can be independently located directly upstream of any one or more of gvpN, gvpF, gvpG, gvpJ, gvpL, gvpK, gvpS, or gvpU and gvpA genes.

In other embodiments, GV genes introduced in the mammalian cell with a GVES of the disclosure can be flanked by recombination sites that are recognized by a recombinase, whose expression or activity is, in turn, activated in response to a biochemical event in the mammalian cell. For example, in these embodiments, one input signal can activate the GV genes organized within a GV gene cluster while a constitutive promoter is positioned in the opposite direction of the gene cluster. The second input would drive a recombinase that flips the promoter so that GV genes can be expressed. Exemplary recombinase systems comprise the piggy-bac integrase system, phiC31 and Bxb1 integrases, and the FLP/FRT or Cre/lox recombination systems, and additional systems identifiable by a skilled person.

The term "Negated AND gate" or "NOT gate" refers to a digital logic gate that behaves according to the truth table shown in Table 5. A 'true' output (1) results if either of the inputs to the OR gate are 'true' (1).

TABLE 5

'Negated AND gate' or "NOT gate" truth table:

| Input | | Output |
|---|---|---|
| A | B | A NOT B |
| 0 | 0 | 0 |
| 0 | 1 | 0 |
| 1 | 0 | 1 |
| 1 | 1 | 0 |

In particular, the term "Negated AND gate" or "NOT gate" as used herein refers to the logical relation between two genetic molecular components in a GVGC genetic circuit, wherein inputs 'A' and 'B' in Table 5 are two biochemical events, and the output 'A OR B' in Table 5 is the production of a certain GV type.

For example, in some embodiments of an "Negated AND gate" or a "NOT gate" comprised in a GVR genetic circuit described herein, the GVGC genetic circuit comprises a plurality of genetic molecular components wherein at least a first genetic molecular component comprises a GV gene cluster, and at least a second genetic molecular component comprises an CRISPR/Cas9 complex configured to inhibit expression of a gvp gene comprised in the GV gene cluster, e.g. a gvpA. In these embodiments, activation of expression and the first genetic molecular component and absence of activation (or repression) of the second genetic molecular component are both required for the output of a GV type in the genetic circuit when the genetic circuit operates according to the design of the genetic circuit. For example, the first and second genetic molecular components can comprise promoters that are activated or repressed by one or more biochemical events in the mammalian cell comprising the GVGC genetic circuit.

In embodiments of the genetic circuits herein described wherein the input is a biochemical event and the output is an intracellular spatial translocation of the GV type, the GV type is a molecular component of the genetic circuit and intracellular spatial translocation of the UV type can occur through one or more converting and/or binding reactions involving the GV type as described herein.

In some embodiments, in the GVR genetic circuit herein described, an expression of the GV type or an intracellular spatial translocation of the GV type occurs when the hybrid GVR genetic circuit operates according to the circuit design in response to a trigger molecular component within the target mammalian cell.

In some embodiments, the trigger molecular component is a molecular component that is capable of being natively produced in the target host in its naturally occurring form. In particular, the natively produced molecular component can be a genetic molecular component or a cellular molecular component.

Examples of natively produced genetic molecular component can be one or more RNA or protein natively encoded in the genome of the naturally occurring form of the mammalian host and natively expressed by the target mammalian host. Examples of cellular molecular components natively produced by the target host comprise metabolites of enzymatic reactions produced by enzymes that are natively expressed by the target mammalian host in its naturally occurring form.

In these embodiments, the GVR genetic circuit comprises a GV type when the GVR genetic circuit operates according to a circuit design in response to the presence of the natively produced molecular component in the target mammalian cell.

In particular, in these embodiments, expression of the GVR in the mammalian host does not require the introduction into the host of any genetic molecular components in addition to the genetic molecular components comprising the GVGC. In these embodiments, the promoter operatively connected to a hybrid GV gene cluster in the GVGC genetic molecular component is configured to be activated in response to molecular components capable of being natively produced by the host in its naturally occurring form, such as natively expressed transcription factors. Genetic molecular components that can be activated by native molecular components include response elements (activating transcription factor 4 response element, activator protein 1 response element, antioxidant response element, cAMP response element, enhancer binding protein response element, hypoxia response element, metal response element, NFAT response element, p53 response element, serum response element, Smad binding element, Xenobiotic response element); additional are identifiable by those skilled in the art. Natively produced proteins or RNAs natively encoded in the genome of a particular mammalian cell hosts comprise transcription factors (SP-1, AP-1, C/EBP, EGR1, HSF, ATF/CREB, GLI1, HIF, c-Myc, Oct-1, p53, NF-1, STAT1) and lncRNAs (B2, roX1, roX2, Xist); additional are identifiable by those skilled in the art. Metabolites produced in biochemical reactions produced in the naturally occurring form of the mammalian host comprise cytokines such as chemokines, interferons (IFNy), interleukins (IL-2, IL-10), lymphokines (CSF1, CSF2, CSF3), and tumor necrosis factors (TNFa), as well as hormones (including endocrine, paracrine, autocrine, and intracrine hormones) and growth factors (BMP, EGF, ephrin, EPO, FGF); additional are identifiable by those skilled in the art.

Thus, in these embodiments, the target host mammalian cell is labeled with expression of a GV type, wherein expression of the GV type occurs in presence of the trigger molecular component that is capable of being natively produced in the target mammalian cell host in its naturally occurring form. In several embodiments described herein, one or more GVR genetic circuits can be introduced into one or more mammalian cell hosts according to genetic engineering methods described herein and known to those skilled in the art. Different cells expressing different GVs would be possible. The methods to introduce the GVES and related GVRMC are identifiable by a skilled person upon reading of the disclosure.

In other embodiments, the trigger molecular component is a heterologous molecular component that is not capable of being natively produced in the target mammalian host in its naturally occurring form. In these embodiments, the GVGC genetic molecular component is not configured to express the GV type in presence of a molecular component that is capable of being natively produced in the target mammalian host in its naturally occurring form, but is instead configured to express the GV type in presence of one or more heterologous (non-natively produced) trigger molecular components e.g. by using cell type specific promoters, described above, and/or viral transduction which would be cell type specific.

In these embodiments, the trigger molecular component can be one or more heterologous molecular components comprising a heterologous genetic molecular component and/or a heterologous cellular molecular component.

In some embodiments, the heterologous genetic molecular component can comprise one or more protein- and/or RNA-encoding genes and/or regulatory elements such as promoters and/or enhancer elements that are not native to the target mammalian genome. In some embodiments, the heterologous genetic molecular component can be introduced into the target prokaryotic host in addition to the one or more genetic molecular components comprising the GVGC. The additional heterologous genetic molecular component can be a constitutively expressed or an inducible genetic molecular component.

In some embodiments, the heterologous cellular molecular component can comprise a molecular component that is naturally present in the environment comprising the target prokaryotic cell, such as a metabolite produced by a mammalian host comprising the target prokaryotic host cell, or it can be a molecular component that is not naturally present in the environment comprising the target prokaryotic host cell, and introduced into the prokaryotic host cell, such as a drug configured to activate expression of the heterologous genetic component.

Accordingly, the GVR circuit of the disclosure comprise a first GVES reporting molecular component, which is a GVES genetic molecular component comprising the GVB cassette and at least one second GVES reporting molecular component which is a GVES genetic molecular component comprising the additional GVP cassettes of the GVES of the disclosure. In GVR circuit of the disclosure the first GVES reporting molecular component and the at least one second GVES reporting molecular component are activated to trigger expression of GV genes gvpB gene gvpN, gvpF, gvpG, gvpL, gvpS, gvpK, gvpJ, and gvpU to provide the gas vesicle in the mammalian cell.

In some embodiments, the GVES genetic molecular component of a GVR circuit in a mammalian host according to the present disclosure comprises promoter and/or enhancer elements that are configured to be activated in response to the presence of a heterologous molecular component. In exemplary embodiments, the promoter is a constitutive promoter such as CMV (e.g., see Example 12, Example 15, Example 24, Example 25). In other exemplary embodiments, the promoter is activated by a heterologous transcription factor that is encoded in a heterologous genetic molecular component introduced into the target mammalian host in addition to the GVGC genetic molecular component; in exemplary embodiments described herein, the GVGC genetic molecular component comprises a promoter controlled by heterologous transcription factors, for example, (tetracycline-dependent repressor fused to transactivation domain (VP16 domain) as illustrated in Example 13 and 18, similarly LacI and LexA fusions to transactivators (e.g. VP16) and repressor domains (KRAB), ET-dependent macrolide-responsive promoter, dead-Cas9 fusion to transactivators and repressors, zinc-finger proteins fused to transactivators and repressors, transcription activator-like effectors fused to transactivators and repressors).

In some embodiments, the GVGC genetic molecular component comprises recombination sites (e.g. piggy-bac recombination sites) surrounding one or more gvp genes comprised in the GV gene cluster or one or more regulatory elements (e.g. promoter) wherein the one or more gvp genes or regulatory elements are introduced into a mammalian host cell in an orientation that prevents expression of the encoded GV type, e.g., the promoter is in reverse orientation relative to the GV gene cluster; in these embodiments a heterologous genetic molecular component comprising the recombinase enzymes required for flipping the orientation of the elements flanked by the recombinase sites in the GVGC genetic molecular component is also introduced into the prokaryotic host cell and expression of the GV type occurs upon recombinase-mediated flipping of the flanked elements in the GVGC genetic molecular component into an orientation allowing initiation of expression of the GV type.

In these embodiments, the GVR genetic circuit comprises a GV type is when the GVR genetic circuit operates according to a circuit design in response to the presence of the one or more heterologous molecular components in the target mammalian cell.

Thus, in these embodiments, the target mammalian host is labeled with expression of a GV type, wherein expression of the GV type occurs in presence of the heterologous trigger molecular component introduced into the target mammalian host.

Accordingly, in some embodiments, a method to provide a genetically engineered mammalian cell comprising one or more GVR genetic circuits is described. The method comprises genetically engineering a mammalian cell by introducing into the cell one or more GVR genetic circuits described herein.

The mammalian cells described herein can be genetically engineered using methods known to those skilled in the art. For example, one or more genetic molecular components of a GVR genetic circuit comprised in vectors described herein can be introduced into mammalian cells using transformation techniques such as lenti-virus, adeno associated virus, adenovirus, baculovirus, nanoparticles that contain genome editing enzymes such as CRISPR, TALENs, ZFNs, transposase and others known to those skilled in the art and described herein. In some embodiments, the genetic molecular components of a GVR genetic circuit are introduced into the mammalian cell to persist as a plasmid or integrate into the genome, following methods known in the art and described herein.

In embodiments herein described, the GVES system and related genetic circuits, cells, vectors, genetically engineered prokaryotic cells, compositions, methods and systems, in several embodiments can be used together with contrast-enhanced imaging techniques to detect and report a biological event the location of and/or biochemical events in genetically engineered mammalian cells in an imaging target site.

The term "contrast enhanced imaging" or "imaging", as used herein indicates a visualization of a target site performed with the aid of a contrast agent present in the target site, wherein the contrast agent is configured to improve the visibility of structures or fluids by devices process and techniques suitable to provide a visual representation of a target site. Accordingly a contrast agent is a substance that enhances the contrast of structures or fluids within the target site, producing a higher contrast image for evaluation. In particular, as used herein, the term "contrast agent" refers to GVs expressed in prokaryotic cells comprised in the target site, the GVs comprised in GVGC genetic circuits in the mammalian cells when the GVGC genetic circuit operates according to a circuit design in response to a biochemical event, as described herein.

The term "target site" as used herein indicates an environment comprising one or more targets intended as a combination of structures and fluids to be contrasted, such as cells. In particular the term "target site" refers to biological environments such as cells, tissues, organs in vitro in vivo or ex vivo that contain at least one target. A target is a portion of the target site to be contrasted against the background (e.g. surrounding matter) of the target site. Accordingly, as used herein a target comprises one or more mammalian cells genetically engineered to comprise one or more GVGC genetic circuits as described herein within any suitable environment in vitro, in vivo or ex vivo as will be understood by a skilled person. Exemplary target sites include collections of microorganisms in vitro as well as cells grown in an in vitro culture, including, primary mammalian, cells, immortalized cell lines, tumor cells, stem cells, and the like. Additional exemplary target sites include tissues and organs in an ex vivo culture and tissue, organs, or organ systems in a subject, for example, lungs, brain, kidney, liver, heart, the central nervous system, the peripheral nervous system, the gastrointestinal system, the circulatory system, the immune system, the skeletal system, the sensory system, within a body of an individual and additional environments identifiable by a skilled person. The term "individual" or "subject" or "patient" as used herein in the context of imaging includes a single plant, fungus or animal and in particular higher plants or animals and in particular vertebrates such as mammals and more particularly human beings.

In some embodiments, imaging the target site comprising the mammalian host can be performed by applying ultrasound to obtain an ultrasound image of the target site.

The term "ultrasound imaging" or "ultrasound scanning" or "sonography" as used herein indicate imaging performed with techniques based on the application of ultrasound. Ultrasound refers to sound with frequencies higher than the audible limits of human beings, typically over 20 kHz. Ultrasound devices typically can range up to the gigahertz range of frequencies, with most medical ultrasound devices operating in the 1 to 18 MHz range. The amplitude of the waves relates to the intensity of the ultrasound, which in turn relates to the pressure created by the ultrasound waves. Applying ultrasound can be accomplished, for example, by sending strong, short electrical pulses to a piezoelectric transducer directed at the target. Ultrasound can be applied as a continuous wave, or as wave pulses as will be understood by a skilled person.

Accordingly, the wording "ultrasound imaging" as used herein refers in particular to the use of high frequency sound waves, typically broadband waves in the megahertz range, to image structures in the body. The image can be up to 3D with ultrasound. In particular, ultrasound imaging typically involves the use of a small transducer (probe) transmitting high-frequency sound waves to a target site and collecting the sounds that bounce back from the target site to provide the collected sound to a computer using sound waves to create an image of the target site. Ultrasound imaging allows detection of the function of moving structures in real-time. Ultrasound imaging works on the principle that different structures/fluids in the target site will attenuate and return sound differently depending on their composition. A contrast agent sometimes used with ultrasound imaging are microbubbles created by an agitated saline solution, which works due to the drop in density at the interface between the gas in the bubbles and the surrounding fluid, which creates a strong ultrasound reflection. Ultrasound imaging can be performed with conventional ultrasound techniques and devices displaying 2D images as well as three-dimensional (3-D) ultrasound that formats the sound wave data into 3-D images. In addition to 3D ultrasound imaging, ultrasound imaging also encompasses Doppler ultrasound imaging, which uses the Doppler Effect to measure and visualize movement, such as blood flow rates. Types of Doppler imaging includes continuous wave Doppler, where a continuous sinusoidal wave is used; pulsed wave Doppler, which uses pulsed waves transmitted at a constant repetition frequency, and color flow imaging, which uses the phase shift between pulses to determine velocity information which is given a false color (such as red=flow towards viewer and blue=flow away from viewer) superimposed on a grey-scale anatomical image. Ultrasound imaging can use linear or non-linear propagation depending on the signal level. Harmonic and harmonic transient ultrasound response imaging can be used for increased axial resolution, as harmonic waves are generated from non-linear distortions of the acoustic signal as the ultrasound waves insonate tissues in the body. Other ultrasound techniques and devices suitable to image a target site using ultrasound, such as non-linear ultrasound imaging such as AM, PI, AMPI, would be understood by a skilled person.

Types of ultrasound imaging of biological target sites include abdominal ultrasound, vascular ultrasound, obstetrical ultrasound, hysterosonography, pelvic ultrasound, renal ultrasound, thyroid ultrasound, testicular ultrasound, and pediatric ultrasound as well as additional ultrasound imaging as would be understood by a skilled person.

Applying ultrasound refers to sending ultrasound-range acoustic energy to a target. The sound energy produced by the piezoelectric transducer can be focused by beamforming, through transducer shape, lensing, or use of control pulses. The soundwave formed is transmitted to the body, then partially reflected or scattered by structures within a body; larger structures typically reflecting, and smaller structures typically scattering. The return sound energy reflected/scattered to the transducer vibrates the transducer and turns the return sound energy into electrical signals to be analyzed for imaging. The frequency and pressure of the input sound energy can be controlled and are selected based on the needs of the particular imaging task and, in some methods described herein, collapsing GVs. To create images, particularly 2D and 3D imaging, scanning techniques can be used where the ultrasound energy is applied in lines or slices which are composited into an image.

In some embodiments, the ultrasound imaging herein described can comprising collapsing a GV type expressed in the genetically engineered mammalian cell by applying collapsing ultrasound to the target site and/or imaging a GV type in the contrast agent by applying imaging ultrasound to the target site.

In some embodiments, a method is described to provide imaging of one or more biochemical events in a mammalian cell comprised in an imaging target site, the method comprising:

introducing into the mammalian cell a genetically engineered Gas Vesicle expression system (GVES) herein described in which the gvp genes encode for proteins of a Gas Vesicle (GV) type, wherein the GV type is a reportable molecular component of a gas vesicle reporting (GVR) genetic circuit, in which molecular components are connected one to another in accordance with a circuit design by activating, inhibiting, binding or converting reactions to form a fully connected network of interacting components, wherein in the GVR genetic circuit an expression of the GV type or an intracellular spatial translocation of the GV type occurs when the GVR genetic circuit operates according to the circuit design in response to the biochemical event the introducing performed for a time and under condition to allow expression of the gvp genes and production of the GV type in the mammalian cell when the GVR genetic circuit operates according to the circuit design; and imaging the target site comprising the mammalian host by applying an imaging ultrasound to the target site at a peak positive pressure below a collapse pressure of the GV type, increasing step-wise the peak positive pressure to above the collapse pressure of the GV type, taking image frames before, during, and after the step-wise increase, and performing signal separation on the image frames to image the GV type In some embodiments, a method is described to label a target mammalian host, the method comprising:

introducing into the target mammalian host a genetically engineered Gas Vesicle expression system (GVES)herein described in which the gvp genes encode for proteins of a Gas Vesicle (GV) type, the introducing performed for a time and under condition to allow expression of the gvp genes and production of the GV type in the mammalian cell, wherein the GV type is a reportable molecular component of a gas vesicle reporting (GVR) genetic circuit, in which molecular components are connected one to another in accordance with a circuit design by activating, inhibiting, binding or converting reactions to form a fully connected network of interacting components, wherein in the GVR genetic circuit an expression of the GV type or an intracellular spatial translocation of the GV type occurs when the GVR genetic circuit operates according to the circuit design in response to a trigger molecular component within the target prokaryotic host;

In the method, the introducing is performed under conditions resulting in presence of the trigger molecular component in the target mammalian host.

In some embodiments, the method can further comprise imaging the target site comprising the target mammalian host, by imaging the target site comprising the mammalian host by applying an imaging ultrasound to the target site at a peak positive pressure below a collapse pressure of the GV type, increasing step-wise the peak positive pressure to above the collapse pressure of the GV type, taking image frames before, during, and after the step-wise increase, and performing signal separation on the image frames to image the GV type.

The ability of GVs to act as a contrast agent for both ultrasound allows them to act as an acoustomagnetic reporter, thus creating possibilities for multimodal imaging. In some embodiments herein described, when collapsing ultrasound is used in combination with MRI imaging, acoustically collapsing a GV type expressed in a mammalian cell can remotely in situ erase the GV type to enable a background-free magnetic resonance imaging of a target site. The background-free magnetic resonance imaging removes background noise posed by background contrast from endogenous sources [33, 34] by allowing GV types to be identified specifically based on their acoustic responses.

Accordingly, in various embodiments herein described imaging of a biochemical event and/or labeling of a mammalian cell can be performed by multiplex imaging as will be understood by a skilled person upon reading of the present disclosure.

In methods herein described, administration of one or more genetically engineered mammalian cell types comprising one or more GVR genetic circuits to a target site to be imaged, can be performed in any way suitable to deliver the one or more mammalian cells comprising a GVR genetic circuit to the target site to be imaged.

In some embodiments, in which the target site is the body of an individual or a part thereof, the one or more genetically engineered mammalian cell types comprising a GVR genetic circuit can be administered to the target site locally or systemically.

The wording "local administration" or "topic administration" as used herein indicates any route of administration by which the one or more genetically engineered bacterial cell types comprising a GVR genetic circuit is brought in contact with the body of the individual, so that the resulting location of the one or more genetically engineered bacterial cell types comprising a GVR genetic circuit in the body is topic (limited to a specific tissue, organ or other body part where the imaging is desired). Exemplary local administration routes include injection into a particular tissue by a needle, gavage into the gastrointestinal tract, and spreading a solution containing the one or more genetically engineered bacterial cell types comprising a GVR genetic circuit on a skin surface.

The wording "systemic administration" as used herein indicates any route of administration by which the one or more genetically engineered bacterial cell types comprising a GVR genetic circuit is brought in contact with the body of the individual, so that the resulting location of the one or more genetically engineered bacterial cell types comprising a GVR genetic circuit in the body is systemic (not limited to a specific tissue, organ or other body part where the imaging is desired). Systemic administration includes enteral and parenteral administration. Enteral administration is a systemic route of administration where the substance is given via the digestive tract, and includes but is not limited to oral administration, administration by gastric feeding tube, administration by duodenal feeding tube, gastrostomy, enteral nutrition, and rectal administration. Parenteral administration is a systemic route of administration where the substance is given by route other than the digestive tract and includes but is not limited to intravenous administration, intra-arterial administration, intramuscular administration, subcutaneous administration, intradermal, administration, intraperitoneal administration, and intravesical infusion.

Accordingly, in some embodiments of methods herein described, administering the one or more genetically engineered mammalian cell types comprising a GVR genetic circuit can be performed topically or systemically by intradermal, intramuscular, intraperitoneal, intravenous, subcutaneous, intranasal, rectal, vaginal, and oral routes. In particular, the one or more genetically engineered mammalian cell types comprising a GVR genetic circuit can be administered by infusion or bolus injection, and can optionally be administered together with other biologically active agents. In some embodiments of methods herein described, administering the one or more genetically engineered mammalian cell types comprising a GVR genetic circuit can be performed by injecting the one or more genetically engineered mammalian cell types comprising a GVR genetic circuit such as in a body cavity or lumen. Upon expression of one or more GV types in one or more genetically engineered bacterial cell types comprised in the target site, the target site can be contrast imaged.

Accordingly, in some embodiments, a vector comprising one or more genetic molecular components of a GVR genetic circuit is described, wherein the vector is configured to introduce the one or more genetic molecular components comprised in a GVR genetic circuit into a mammalian cell.

The term "vector" indicates a molecule configured to be used as a vehicle to artificially carry foreign genetic material into a cell, where it can be replicated and/or expressed. An expression vector is configured to carry and express the material in a cell under appropriate conditions. In some embodiments, a suitable vector can comprise a recombinant plasmid, a recombinant non-viral vector, or a recombinant viral vector. Vectors described herein can comprise suitable promoters, enhancers, post-transcriptional and post-translational elements for expression in mammalian that are identifiable by those skilled in the art. Vectors suitable for transduction of mammalian cells, are known to those skilled in the art. Exemplary vectors for transformation of a mammalian cell with genetic molecular components comprising GV gene clusters are described herein in the Examples.

Accordingly, in some embodiments herein described, a genetically engineered mammalian cell and in particular a genetically engineered mammalian cell comprising one or more GVR genetic circuits is described.

In embodiments herein described, a composition is provided. The composition comprises one or more genetic molecular components of a GVR genetic circuit, vectors, or genetically engineered mammalian cells described herein together with a suitable vehicle.

The term "vehicle" as used herein indicates any of various media acting usually as solvents, carriers, binders or diluents for the one or more genetic molecular components, vectors, or prokaryotic cells herein described that are comprised in the composition as an active ingredient. In particular, the composition including the one or more genetic molecular components, vectors, or prokaryotic cells herein described can be used in one of the methods or systems herein described.

In some embodiments, the GVGC comprised in a genetic molecular component of a GVR genetic circuit can be engineered (e.g. by modifying the related gvp genes) to produce GV types with altered mechanical, acoustic, surface and targeting properties in order to achieve enhanced harmonic responses and multiplexed imaging to be better distinguished from background tissues. In particular, in some embodiments, a GV can be engineered to tune the related acoustic properties. In particular the engineering can be performed by genetically engineering a GV having an acoustic collapse pressure $aP_0$ performed to obtain a variant GV with a critical collapse pressure $aP_1$ lower than the $aP_0$.

In particular, in order to tune the acoustic collapse properties of the GV, one changes the structural proteins of the GV shell. For example, selecting proteins that make the GV shell longer, rounder, thicker, etc. or that add proteins to the shell that make it structurally stronger. Changes in the shape, size, and durability of the GV shell change its acoustic properties as will be understood by a skilled person.

Accordingly, in embodiments described herein, GVR genetic circuits comprising genetically-encoded GV types can be used together with contrast-enhanced imaging techniques such as ultrasound imaging and/or MRI to detect the location of and/or dynamic biochemical events in prokaryotic cells in an imaging target site, wherein the mammalian cells have been genetically engineered to comprise one or more GVR genetic circuits described herein. In some exemplary embodiments, this allows monitoring the activity of various natural and engineered signaling circuits in mammalian cells.

In some exemplary embodiments described herein, imaging of engineered mammalian cells expressing GV types in vivo allows imaging of engineered mammalian cells in target sites. However, conventional reporters based on fluorescent and luminescent proteins or radionuclide capture suffer from the poor penetration of light into tissue or the need to administer radioactive tracers [35-37]. In contrast to these techniques, ultrasound and MRI are widely available, inexpensive, radiation-free technologies capable of noninvasively imaging deep tissues [38]. For example, the spatial resolution of ultrasound is routinely on the order of 100 µm [39, 40] and can approach the single-micron level with recently developed super-resolution techniques [41]. With these performance characteristics and the ability to place signals within an anatomical context, ultrasound is an ideal technique for imaging microbes in vivo.

As described herein, GVESs and related polynucleotide constructs, GVR genetic circuits, vectors, genetically engineered mammalian cells, compositions, methods and systems can be used in several embodiments to detect biochemical events in mammalian cells In particular embodiments, the GVES and related genetic circuits, vectors, genetically engineered mammalian cells, compositions, methods and systems described herein enable cell imaging inside mammalian hosts.

In some embodiments described herein, GV type-expressing mammalian cells can be visualized in vivo in settings relevant to cell tracking such as immune cells, circulating tumor cells, stem cells, blood cells, or tracking of cellular parts around the body such as exosomes, differentiation of cells in stem cells and progenitor cells, genetic changes to cells, and additional settings identifiable by a skilled person. In exemplary embodiments described herein, expression of GV types can make mammalian cells visible to ultrasound at volumetric concentrations below 0.5%, allowing dynamic imaging of gene expression and other biochemical events, and allows the visualization in vivo, such as in tumor xenografts as shown in the Examples.

In some embodiments described herein, engineered gas vesicle gene clusters are used as reporter genes for ultrasound, giving this widely used noninvasive imaging modality the ability to visualize bacteria inside living animals with sub-100 µm resolution. In several embodiments described herein, transformation with GVES systems of the disclosure allow mammalian cells to be detected at concentrations above 3 mammalian cells per ultrasound voxel, making this technology relevant to a broad range of studies, demonstrating the ability of GVGC-expressing mammalian cells to be detected within living animals at relevant concentrations.

In some embodiments, the GVs and variants thereof comprised in GVR genetic circuits described herein can be used as a contrast agent in the contrast-enhanced imaging methods herein described.

In particular, a combination of different GV types and/or variants thereof comprised in GVR genetic circuits can be used as contrast agents, each expressed GV exhibiting a different acoustic collapse profile with progressively decreased midpoint collapse pressure values. In some cases, the percentage difference between the midpoint collapse pressure values of any given two expressed GVs types is at least twenty percent.

As mentioned above, the GV gene cluster and related GVR circuit, molecular component, polynucleotidic constructs, vectors, cells and compositions herein described can be provided as a part of systems to perform any of the above mentioned methods. The systems can be provided in the form of kits of parts. In a kit of parts, one or more the hybrid GV gene cluster and related GVR circuit, molecular component, polynucleotidic constructs, vectors, cells and other reagents to perform the methods herein described are comprised in the kit independently. The hybrid GV gene cluster and related GVR circuit, molecular component, polynucleotidic constructs, vectors, cells can be included in one or more compositions, and each the hybrid GV gene cluster and related GVR circuit, molecular component, polynucleotidic construct, vector and cell is in a composition together with a suitable vehicle.

In particular, the components of the kit can be provided, with suitable instructions and other necessary reagents, in order to perform the methods here disclosed. The kit will normally contain the compositions in separate containers. Instructions, for example written or audio instructions, on paper or electronic support such as tapes or CD-ROMs, for carrying out the assay, will usually be included in the kit. The kit can also contain, depending on the particular method used, other packaged reagents and materials (such as, wash buffers and the like).

The genetically engineered GVES, and related genetic circuits, vectors, genetically engineered mammalian cells, compositions, methods and systems herein described can be used in several embodiments to provide magnetic resonance imaging with enhanced contrast and molecular sensitivity at sub-nanomolar concentration.

The genetically engineered GVES, and related genetic circuits, vectors, genetically engineered mammalian cells, compositions, methods and systems herein described can be used in connection with various applications wherein contrast-enhanced imaging of a target site is desired. For example, the genetically engineered GVES, and related genetic circuits, vectors, genetically engineered mammalian cells, compositions, methods and systems herein described can be used for visualization of mammalian cells as part or introduced into a mammalian host, such as mammalian hosts, facilitating for example the study of the mammalian microbiome and the development of diagnostic and therapeutic prokaryotic cellular agents, among other advantages identifiable by a skilled person, in medical applications, as well diagnostics applications. Additional exemplary applications include uses of the genetically engineered GVES, and related genetic circuits, vectors, genetically engineered mammalian cells, compositions, methods and systems herein described in several fields including basic biology research, applied biology, bio-engineering, bio-energy, medical research, medical diagnostics, therapeutics, and in additional fields identifiable by a skilled person upon reading of the present disclosure.

Further details concerning the genetically engineered GVES, and related genetic circuits, engineered mammalian cells and methods of the present disclosure will become more apparent hereinafter from the following detailed disclosure of examples by way of illustration only with reference to an experimental section.

EXAMPLES

The polynucleotide constructs, and related genetic circuits, vectors, genetically engineered mammalian cells, compositions, methods and systems herein disclosed are further illustrated in the following examples, which are provided by way of illustration and are not intended to be limiting.

In particular, the following examples illustrate exemplary methods and protocols for providing and using polynucleotide constructs, and related genetic circuits, vectors, genetically engineered mammalian cells, compositions, methods and systems. A person skilled in the art will appreciate the applicability and the necessary modifications to adapt the features described in detail in the present section, to additional genetically engineered GVES, and related genetic circuits, vectors, genetically engineered mammalian cells, compositions, methods and systems according to embodiments of the present disclosure.

The following materials and method were used in the exemplary embodiments reported in this section.
Chemicals, Cell Lines and Synthesized DNA:

All chemicals were purchased form Sigma Aldrich unless otherwise noted. HEK293T and CHO-K1 cell lines were ordered from American Type Culture Collection (ATCC)

and HEK293 tetON cells and CHO tetON cells were purchased form Clontech (Takara Bio). Synthetic DNA was ordered from Twist Bioscience.

Cloning

Monocistronic plasmids used for transient transfection of HEK293T cells of gas vesicles genes used the pCMVSport backbone and codon optimized gas vesicle genes were assembled in each plasmid using Gibson assembly. To test the effect of N- and C-terminal p2A modification each *B. megaterium* gas vesicle gene on the pNL29 plasmid (addgene 91696) was individually cloned. To test the N-terminal modification, the CCT codon was mutagenized following the start codon. To test the C-terminal modification, linker-p2A sequence (GGAGCGCCAGGTTCCGGGGC-TACTAACTTCAGCCTCCT-TAAACAGGCCGGCGACGTGGAAGAGAATCCTGGC) (SEQ ID NO: 32) was mutagenized upstream of the stop codon for each gene.

The PiggyBac transposon system (System Biosciences) was used to genomically integrate the ARG cassettes. To clone the ARG cassettes to the PiggyBac transposon backbone, the plasmid was first restriction digested using SpeI/HpaI and the ARG cassettes were Gibson assembled to the backbone. For tetracycline inducible expression, the CMV promoter upstream of the GV genes was replaced with TRE3G promoter.

Cell Culture, Transient Transfection and TEM Analysis

HEK 293T and CHO-K1 cells were cultured in DMEM with 10% FBS and penicillin/streptomycin and seeded in a 6-well plate for transfection experiments. When the cells reached 70-80%, 2 µg of total DNA (plasmids encoding gas vesicle genes) was transiently transfected into the culture using 2.58 µg polyethyleneimine per µg DNA for 12-18 hours. Cells were allowed to express the recombinant proteins for 72 hours.

Cells expressing gas vesicles in 6-well plates were lysed with 400 µL of Solulyse-M per well for one hour at 4° C. The lysate was then transferred to 2 mL tubes, diluted with 1.2 mL of 10 mM HEPES buffer at pH 8.0 and centrifugated overnight at 300 g at 8° C. Then, 60 µL of the supernatant transferred to a fresh tube to be analyzed using transmission electron microscopy (TEM).

From this top fraction, 2 µL of sample was added to Formvar/carbon 200 mesh grids (Ted Pella) that were rendered hydrophilic by glow discharging (Emitek K100X). The samples were then stained with 2% uranyl acetate. The samples were imaged on a FEI Tecnai T12 transmission electron microscope equipped with a Gatan Ultrascan CCD.

Genomic Integration and FACS (and 96 Well Plate Monoclonal)

HEK293 tetON and CHO tetON cells were used for genomic integration of the mammalian ARG. The cells were cultured in a 6-well plate containing 2 mL DMEM with 10% tetracycline-free FBS (Clonetech) and penicillin/streptomycin. Cells were transfected with the PiggyBac transposon backbone containing the ARG genes and the PiggyBac transposase plasmid at a transposon:transposase molar ration of 2.5:1. Transfection was conducted using parameters mentioned above and the cells were allowed to incubate for 72 hours. Cells were induced with 1 µg/mL of doxycycline 24 hours prior to FACS. To obtain a polyclonal ARG-expressing cell population, the top 10% brightest fluorescent positive cells were sorted. For monoclonal cell lines, 576 cells from the 10% brightest fluorescent positive cells population were sorted in individual wells of 96-well plate and the surviving 30 cells were analyzed.

Control mCherry-only cells were constructed similar to ARG-expressing cells. PiggyBac transposon plasmid containing TRE3G promoter driving mCherry were used to make a stable cell line. After genomic integration using PiggyBac, the top 10% brightest fluorescent positive ells were sort.

Gas Vesicle Yield Measurement, Size Distribution and Cell Sectioning with TEM

TEM analysis of gas vesicle yield and size distribution analysis was conducted by seeding cells in 6-well plates and inducing gas vesicle expression using 1 µg/mL of doxycycline and 5 mM sodium butyrate for 72 hours. The cells were lysed using Solulyse-M and buoyancy enriched at 300 g at 8° C. overnight. The top fraction of the supernatant was fixed with 2M urea before being added to Formvar/carbon grids. The TEM grids were washed with water before staining with 2% uranyl acetate. To calculate gas vesicle yield per cell, the total number of gas vesicles per sub-grid on the TEM grid was manually counted. Gas vesicle side distribution was quantified using FIJI.

To visualize gas vesicles inside cells, ARG-expressing cells were seeded in 6-well plates and allowed to express gas vesicles for 72 hours. The cells were fixed with 4% paraformaldehyde. Cell sectioning and electron microscopy was conducted by Oak Crest Institute of Science.

In Vitro Toxicity Assays

The viability of the ARG-expressing cells was determined using three different assays involving cellular metabolic activity (Resazurin reduction, MTT assay), quantification of cellular ATP content (CellTiter-Glo, Promega), and dye exclusion (Trypan Blue, Caisson Labs). The measurements were all quantified as percent viability compared with control cells that expressed mCherry only. For the MTT and CellTiter-Glo assays, cells were grown in 96-well plates and induced with 1 µg/mL doxycycline and 5 mM sodium butyrate for 72 hours. They were then treated with reagents according the manufacturers' protocols. Luminescence (CellTiter-Glo) and absorbance at 540 nM (MTT) was measured using a SpectraMax M5 spectrophotometer (Molecular Devices). For the Trypan Blue assay, the cells were first grown in 6-well plates and treated with 1 µg/mL doxycycline and 5 mM sodium butyrate for 72 hours. They were then trypsinized and resuspended in media before being stained 1:1 with Trypan Blue dye. Ten µL of the solution was loaded in a disposable hemocytometer (C-chip DHC S02, Incyto) and total cell count and blue-stained dead cells were quantified by bright field microscopy.

In Vitro Ultrasound Imaging

To create phantoms for in vitro ultrasound imaging, wells were casted with molten 1% w/v agarose in PBS using a custom 3D-printed template. ARG-expressing and mCherry-only control cells were allowed to express gas vesicles using the specified inducer concentrations and expression duration. They were then trypsinized and counted via disposable hemocytometers in bright field microscopy. Next, cells were mixed at a 1:1 ratio with 50° C. agarose and loaded into the wells before solidification. The volume of each well is 60 µl and contain $6\times10^6$ cells. The phantoms were submerged in PBS, and ultrasound images were acquired using a Verasonics Vantage programmable ultrasound scanning system and L22-14v 128-element linear array transducer with a 0.10-mm pitch, an 8-mm elevation focus, a 1.5-mm elevation aperture, and a center frequency of 18.5 MHz with 67% —6 dB bandwidth (Verasonics, Kirkland, Wash.). Each frame was formed from 89 focused beam ray lines, each with a 40-element aperture and 8 mm focus. A 3-half-cycle transmit waveform at 17.9 MHz was applied to each active array element.

For each ray line, the AM code is implemented using one transmit with all elements in the aperture active followed by 2 transmits in which the odd- and then even-numbered elements are silenced. Each image contains a circular cross-section of a well with a 4 mm diameter and center positioned at a depth of 8 mm. In AM mode, signal was acquired at 0.9 MPa (2V) for 10 frames and the acoustic pressure was increased to 4.3 MPa (12V) to collect 46 frames. There after the acoustic pressure was increased to 8.3 MPa (25V) to ensure complete collapse of gas vesicles. Gas vesicle-specific signal was determined by subtracting the area under the curve of the first sequence by the post-collapse imaging sequence.

Cytotoxicity Assay on Cells Exposed to Ultrasound

ARG-expressing and mCherry-only cells were cultured on custom made Mylar-bottom 24-well plates. Cells were cultured on fibronectin coated Mylar films until they reached 80% confluency and induced for gas vesicle expression for 3 days. The cells were then insonated from the bottom using a L22-14v 128-element linear array transducer (Verasonics). The transducer was mounted on a computer-controlled 3D translatable stage (Velmex). The bottom of the plates was acoustically coupled to the transducer with water and positioned 8 mm away from the transducer face. The cells were exposed to 8.3 MPa of pressure and the transducer was translated at a rate of 3.8 mm/s. The plates were returned to the incubator to allowed to rest for 24 hours. Cytotoxocity was assayed using Resazurin reduction (MTT) on cells exposed to ultrasound and compared to non-insonated negative control cells.

3D Cell Culture and In Vitro Acoustic Recovery after Collapse

ARG-expressing and mCherry-only cells were mixed in Matrigel (Corning) containing 1 µg/mL of Doxycycline and 5 mM sodium butyrate. The cell-laden hydrogels were placed in a 1% agarose base to prevent cell migration out of the hydrogel and separate the cells away from bottom of plates for imaging. Cells were cultured for total of 6 days and imaged every 3 days from the top using a L22-14v 128-element linear array transducer (Verasonics). The transducer was wiped with 70% ethanol and imaging is conducted in a tissue culture hood to preserve sterility. After imaging, all cells were exposed to 8.3 MPa ultrasound to ensure complete collapse of all gas vesicles in the cells at a rate of 1-2 mm/s. The culture media was changed daily and contained 1 µg/mL of Doxycycline and 5 mM sodium butyrate.

In Vivo Expression of Gas Vesicles and Ultrasound Imaging

All in vivo experiments were performed on NOD SCID mouse (NOD.CD17 Prkdc$^{scid}$/NCrCrl; Charles River), aged 10-15 weeks, under a protocol approved by the Institutional Animal Care and Use of Committee of the California Institute of Technology. The lower half of mice were shaved to allow for fluorescence imaging and ultrasound coupling. ARG-expressing and mCherry-only cells were cultured in tetracycline-free media in T225 flasks and 10-12 million cells were trypsinized and mixed with Matrigel (Corning) containing 5 mM sodium butyrate. The ARG-expressing cell and Matrigel mixture was injected subcutaneously in the left flank of mice and mCherry-only cell and Matrigel mixture was injected subcutaneously in the right flank of mice. Starting from the day of tumor inoculation, mice we interperitoneally injected with 200 µl of saline containing 75 µg of Doxycycline and 25 mg of sodium butyrate daily.

Example 1: Identification of Gyp Genes and Protein Sequences Through Alignment

Gyp genes and related protein can be identified through alignment of sequences in databases or identified through wet bench experiments with an approach and techniques identifiable by a skilled person.

Taking as gvpA/B as an example, the identification can be performed using consensus sequence: SSSLAEVL-DRILDKGXVIDAWARVSLVGIEILTIEARVVI-ASVDTYLR (SEQ ID NO: 3) wherein X can be any amino acid. LDRILD (SEQ ID NO: 4), RILDKGXVIDAWARVS (SEQ ID NO: 5) wherein X can be any amino acid, and/or DTYLR (SEQ ID NO: 6), and/or of exemplary gvpA and gvpB protein sequences already identified, as it will be understood by a skilled person.

FIG. 1 shows an exemplary Clustal omega alignment of amino acid sequences of selected exemplary gvpA and gvpB proteins.

The gvpA and gvpB proteins shown are from the following species: Sa_A2, *Serratia* sp. ATCC 39006 gvpA2; Sa_A3, *Serratia* sp. ATCC 39006 gvpA3; Sc_A2, *Streptomyces coelicolor* gvpA2; Sc_A1, *Streptomyces coelicolor* gvpA1; Fc_A, *Frankia* sp. gvpA; Bm_B1, *B. megaterium* gvpB1; Mb_A, *Methanosarcina barkeri* gvpA; Hv_A, *Halorubrum vacuolatum* gvpA; Hm_A, *Haloferax mediterranei* gvpA; Hs_A1, *Halobacterium* sp. NRC-1 gvpA1; Hs_A2, *Halobacterium* sp. NRC-1 gvpA2; Bm_A, *B. megaterium* gvpA; Bm_B2, *B. megaterium* gvpB2; Af_A, *A. flos-aquae* gvpA; Ma_A; Sa_A1, *Serratia* sp. ATCC 39006 gvpA1.

The bottom row of FIG. 1 indicated as "Consensus" shows an exemplary consensus sequence derived from alignment of the gvpA and gvpB amino acid sequences shown.

Homology-based searching (e.g., BLAST alignment) of sequences of proteins encoded in the genome of a prokaryotic organism compared to the exemplary consensus sequence shown in FIG. 1 can be used to identify gvpA and/or gvpB protein sequences in the prokaryotic organism.

Example 2: Identification Gyp Genes and Protein Sequences Through Phylogenesis

Gyp genes and related protein can be identified based on phylogenetic relationships of sequences in databases or identified through wet bench experiments with an approach and techniques identifiable by a skilled person.

In particular, exemplary gvpA, gvpF and gvpN genes and proteins were identified phylogenetic relationships as shown below.

Figure 2:
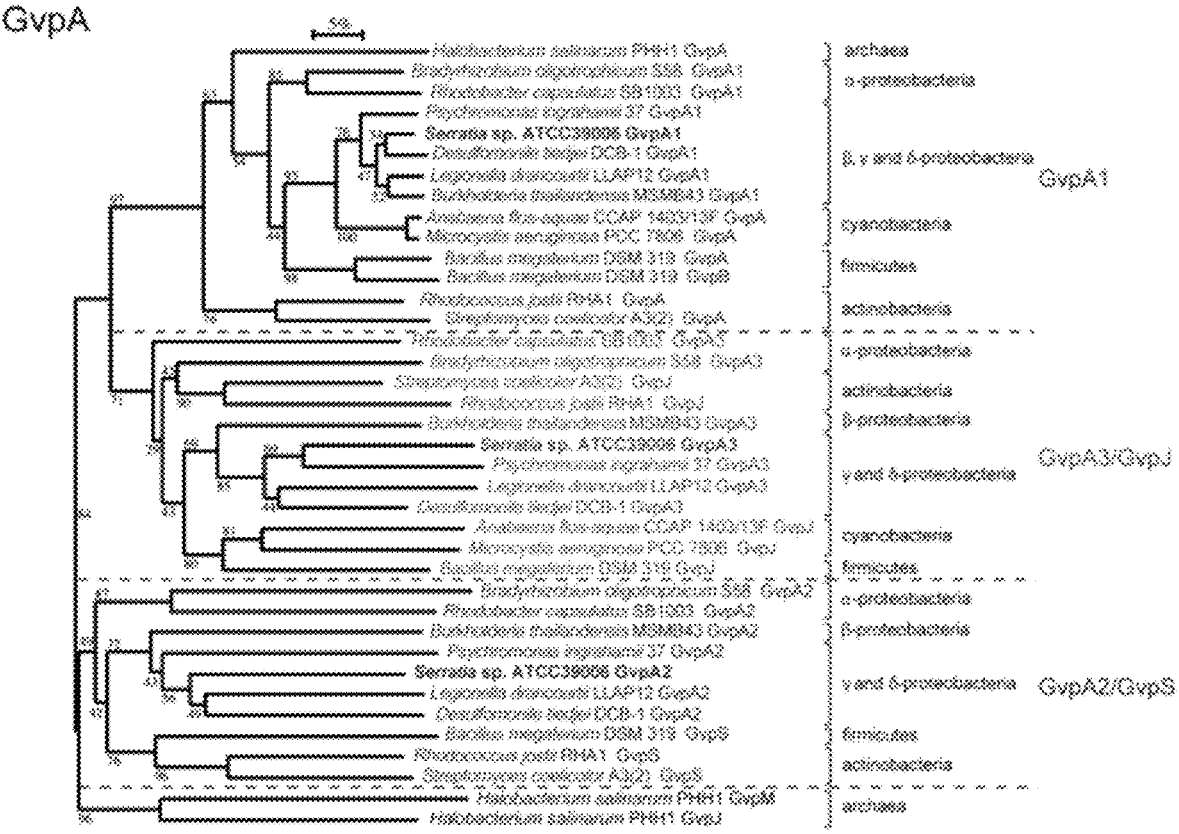
FIG. 2 shows exemplary phylogenetic relationships of the gvpA protein sequences from the indicated prokaryotic species. [1]

FIG. 2 shows exemplary phylogenetic relationships of the gvpA protein sequences from the indicated prokaryotic species [1]. Table 6 lists examples of GV protein sequences from a number of prokaryotic species.

Identification of a gvpA/B protein can be performed by comparing the sequence of an unknown protein in a prokaryotic cell with that of a known gvpA sequence from the closest phylogenetic relative of the prokaryotic species, such as those indicated in the exemplary phylogenetic tree diagram in FIG. 2. Alternatively, identification of gvpA/B can be done through protein alignment algorithms (e.g. BLAST) with the gvpA/B consensus sequence provided in this document, where the protein identity has 60% or higher to this sequence.

Figure 3:
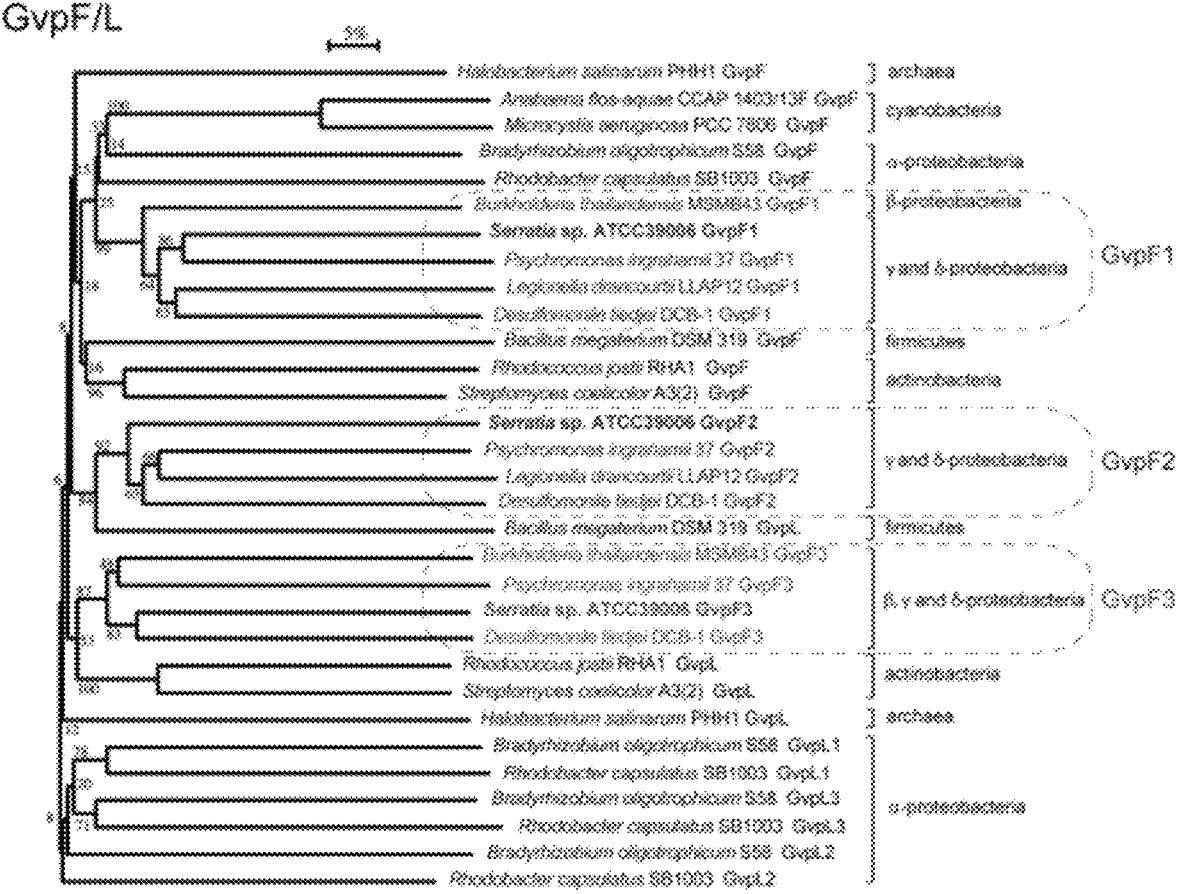
FIG. 3 shows exemplary phylogenetic relationships of the gvpF and gvpL protein sequences from the indicated prokaryotic species. [1]

FIG. 3 shows exemplary phylogenetic relationships of the gvpF and gvpL protein sequences from the indicated prokaryotic species [1]. In some embodiments described herein, the identification of a gvpF protein can be performed by comparing the sequence of an unknown protein in a prokaryotic cell with that of a known gvpF sequence from the closest phylogenetic relative of the prokaryotic species, such as those indicated in the exemplary phylogenetic tree diagram in FIG. 3.

Figure 4:
FIG. 4 shows exemplary phylogenetic relationships of the gvpN protein sequences from the indicated prokaryotic species. [1]

FIG. 4 shows exemplary phylogenetic relationships of the gvpN protein sequences from the indicated prokaryotic species [1]. In some embodiments described herein, the identification of a gvpN protein can be performed by comparing the sequence of an unknown protein in a prokaryotic cell with that of a known gvpN sequence from the closest phylogenetic relative of the prokaryotic species, such as those indicated in the exemplary phylogenetic tree diagram in FIG. 4.

The protein sequences provided in Table 6 can also be used with protein alignment algorithms to identify gvps. Where the using BLAST or other tools, if the top 100 based on protein identity or 100 lowest E-values are identified as "gas vesicle protein" or "gvp" or "gas vesicle structural protein", the protein can be designated as a gas vesicle protein.

Example 3: Identification of Gyp Genes and Proteins Through Analysis of Configuration Vesicle Gene Clusters in Prokaryotes Identification of gvp genes and proteins can be performed also GV cluster configuration of gas vesicle gene clusters in prokaryotes which can be used to identify the specific genes forming a GV cluster in a microorganism, in combination with use of consensus sequences, alignment and/or phylogenetic analysis of GV clusters.

Figure 5:
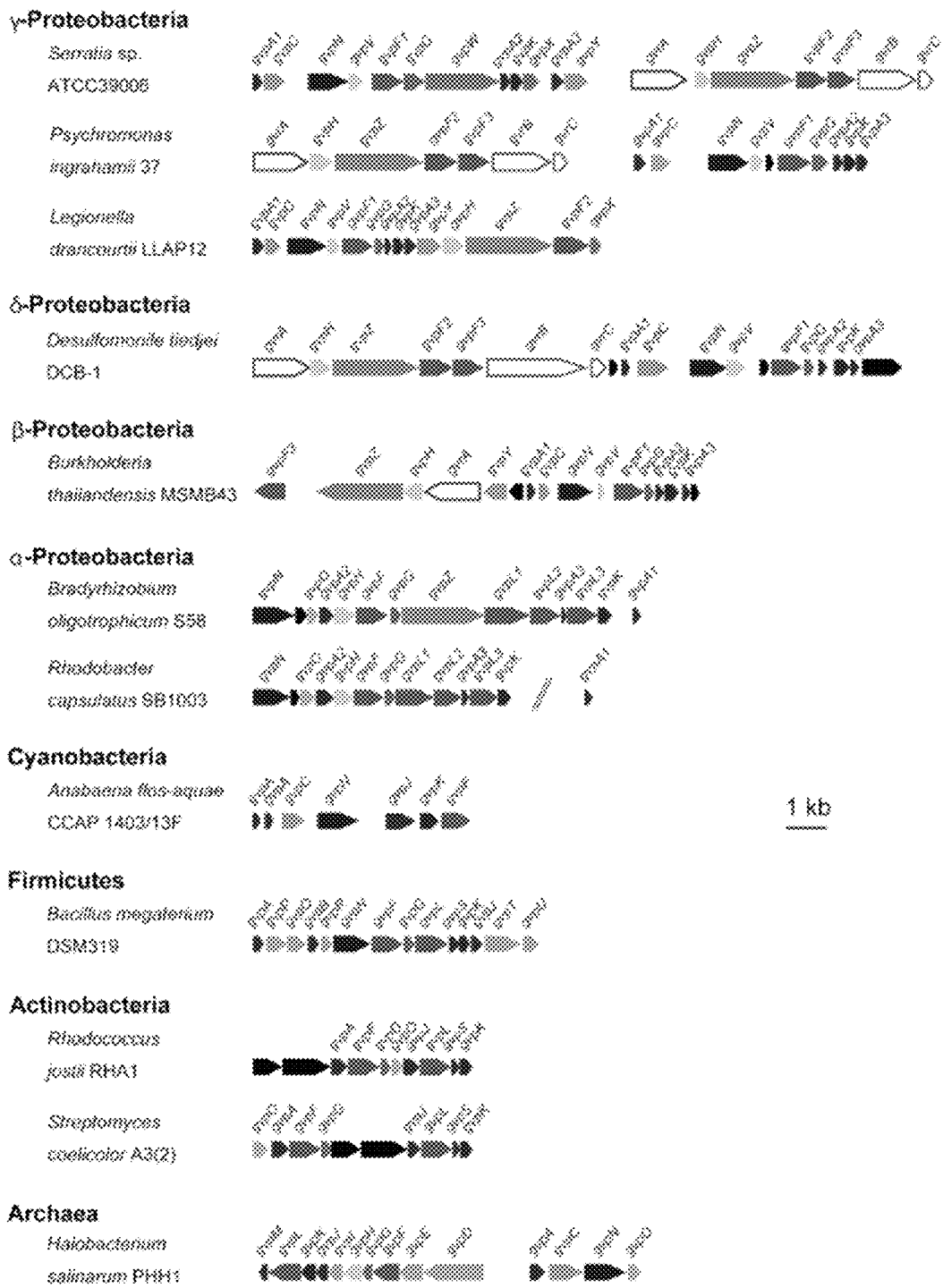
FIG. 5 shows diagrams illustrating the organization of exemplary gas vesicle gene clusters. Gas vesicle gene clusters from the indicated organisms are shown, with genes shown as block-shaped arrows, and genes of predicted similar function indicated in the same shade of grey. The direction of the transcription of genes within a gene cluster is indicated by the direction of the block-shaped arrows, and genes grouped together having block arrows pointed in the same direction are typically organized in the same operon. The scale bar indicates 1 kb. [1]

FIG. 5 shows diagrams illustrating the organization of exemplary gas vesicle gene clusters. Gas vesicle gene clusters from the indicated organisms are shown, with genes shown as block-shaped arrows, and genes of predicted similar function indicated in the same shade of grey. The direction of the transcription of genes within a gene cluster is indicated by the direction of the block-shaped arrows, and genes grouped together having block arrows pointed in the same direction are typically organized in the same operon. The scale bar indicates 1 kb [1].

In addition, FIG. 6 shows diagrams illustrating organization of exemplary gvp gene clusters, wherein each letter indicates a gvp gene, and an arrow beneath a group of letters indicates an operon, with the direction of the arrow indicating the direction of transcription [2].

To identify gvp genes and gvp gene cluster, the following methodology can be used:

1. Using the 60+% gvpA/B and/or 50%+ gvpN consensus sequences and/or gvp sequences provided in Table 6, identify gvp genes on the genome of the prokaryote.
2. For a gvp gene identified, test the next 10 protein coding sequences on both side of the gene to determine if it is gvp gene. Using BLAST or other tools, if the top 100 based on protein identity or 100 lowest E-values are identified as "gas vesicle protein" or "gvp" or "gas vesicle structural protein", the protein can be designated as a gas vesicle protein.
3. If the adjacent genes are labeled as gvp gene, continue testing the next 10 protein coding sequences on both sides of the protein, moving away from the labeled gvp genes. Use criterion 2 to continue identifying gvp genes. If the adjacent 10 genes are not marked as gvp genes continue to next part.
4. The genes at the extreme ends will mark the edge of the gene cluster and all the genes inside are part of the gene cluster than can be tested for heterologous expression gas vesicle in bacteria/mammalian cells. In some cases, there can be one or more gene clusters encoding gvp genes, therefore all the gene clusters are tested during heterologous expression.

In particular, the above methodology can be one way to identify gvp gene clusters in an unannotated or mis-annotated genome as will be understood by a skilled person.

Example 4: Amino Acid Sequences of Exemplary GV Proteins Including GVS and GVA Proteins Several gvp genes and related proteins have been identified and are available in accessible databases.

In particular, Tables 6-10 show amino acid sequences of exemplary GVS (gvpA/B or gvpC) and GVA proteins from several exemplary prokaryotic species. In particular, these exemplary amino acid sequences can be used as reference amino acid sequences in some embodiments for homology-based searches for related GVS and GVA proteins.

TABLE 6

Amino acid sequences of exemplary gvpA/B, gvpF, gvpF/L, gvpG, gvpJ, gvpK, gvpL, gvpN, gvpV, gvpW, gvpR, gvpS, gvpT, and gvpU proteins

| Species, protein; | Amino acid sequence | SEQ ID NO.: |
|---|---|---|
| gvpA/B | | |
| Ana-family-consensus_gvpA | MAVEKTNSSSSLAEVIDRILDKGIVIDAWVRVSLVGIELLAIEARXV IASVETYLKYAEAVGLTXSAAVPAX | 33 |
| Aphanizomenon-flos-aquae_gvpA | MAVEKTNSSSSLAEVIDRILDKGIVIDAWVRVSLVGIELLAIEARIVI ASVETYLKYAEAVGLTQSAAVPA* | 34 |
| Aphanothece-halophytica_gvpA | MAVEKTNSSSSLGEVVDRILDKGVVVDLWVRVSLVGIELLAVEAR VVVASVETYLKYAEAVGLTSSAAVPAE* | 35 |
| Anabaena-flos-aquae_gvpA | MAVEKTNSSSSLAEVIDRILDKGIVIDAWVRVSLVGIELLAIEARIVI ASVETYLKYAEAVGLTQSAAVPA* | 36 |
| Ancylobacter-aquaticus_gvpA | MAVEKINASSSLAEVVDRILDKGVVVDAWVRVSLVGIELLAVEAR VVVAGVDTYLKYAEAVGLTASAQAA* | 37 |

TABLE 6-continued

Amino acid sequences of exemplary gvpA/B, gvpF, gvpF/L, gvpG, gvpJ, gvpK, gvpL, gvpN, gvpV, gvpW, gvpR, gvpS, gvpT, and gvpU proteins

| Species, protein; | Amino acid sequence | SEQ ID NO.: |
|---|---|---|
| Aquabacter-spiritensis_gvpA | MAVEKINASSSLAEVVDRILDKGVVVDAWVRVSLVGIELLAVEAR VVVAGVDTYLKYAEAVGLTAGAQAA* | 38 |
| Arthrospira-sp-PCC-8005_gvpA | MAVEKVNSSSSLAEVIDRILDKGIVIDAWVRVSLVGIELLSVEARV VIASVETYLKYAEAVGLTAQAAVPSV* | 39 |
| Calothrix-sp-strain-PCC-7601_gvpA | MAVEKTNSSSSLAEVIDRILDKGIVVDAWVRVSLVGIELLAIEARIV IASVETYLKYAEAVGLTQSAAVPA* | 40 |
| Dactylococcopsis-salina-PCC-8305_gvpA1 | MAVEKTNSSSLGEVVDRILDKGVVVDLWVRVSLVGIELLAVEAR VVIASVETYLKYAEAVGLTSSAAVPAE* | 41 |
| Dolichospermum-circinale-AWQC131C_gvpA | MAVEKTNSSSSLAEVIDRILDKGIVIDAWVRVSLVGIELLAIEARIVI ASVETYLKYAEAVGLTQSAAVPA* | 42 |
| Dolichospermum-lemmermannii_gvpA | MAVEKTNSSSSLAEVIDRILDKGIVIDAWVRVSLVGIELLAIEARIVI ASVETYLKYAEAVGLTQSAAVPA | 43 |
| Enhydrobacter-aerosaccus_gvpA1 | MAVEKMNASSSLAEVVDRILDKGIVIDAWVRVSLVGIELLAVEAR VVVAGVDTYLKYAEAVGLTAGAEAA* | 44 |
| Lyngbya-confervoides-BDU14195 1_gvpA | MAVEKVNSSSSLAEVVDRILDKGIVVDAWVRVSLVGIELLAIEAR VVIASVETYLKYAEAVGLTAQAAVPAS* | 45 |
| Nostoc-punctiforme-PCC-73102_gvpA | MAVEKVNSSSSLAEVIDRILDKGIVIDAWVRVSLVGIELLSIEARIVI ASVETYLRYAEAVGLTSQAAVPSAA* | 46 |
| Nostoc-sp-PCC-7120_gvpA | MAVEKTNSSSSLAEVIDRILDKGIVVDAWVRVSLVGIELLAIEARIV IASVETYLKYAEAVGLTQSAAMPA* | 47 |
| Microchaete-diplosiphon_gvpA | MAVEKTNSSSSLAEVIDRILDKGIVVDAWVRVSLVGIELLAIEARIV IASVETYLKYAEAVGLTQSAAVPA* | 48 |
| Microcystis-aeruginosa-NIES-843_gvpA1 | MAVEKTNSSSSLAEVIDRILDKGIVIDAWARVSLVGIELLAIEARVV IASVETYLKYAEAVGLTQSAAVPA* | 49 |
| Microcystis-aeruginosa-NIES-843_gvpA2 | MAVEKTNSSSSLAEVIDRILDKGIVIDAWARVSLVGIELLAIEARVV IASVETYLKYAEAVGLTQSAAVPA* | 50 |
| Microcystis-aeruginosa-NIES-843_gvpA3 | MAVEKTNSSSSLAEVIDRILDKGIVIDAWARVSLVGIELLAIEARVV IASVETYLKYAEAVGLTQSAAVPA* | 51 |
| Microcystis-flos-aquae-TF09_gvpA | MAVEKTNSSSSLAEVIDRILDKGIVIDAWARVSLVGIELLAIEARVV IASVETYLKYAEAVGLTQSAAVPA* | 52 |
| Phormidium-tenue-NIES-30_gvpA | MAVEKVNSSSSLAEVVDRILDKGIVIDAWVRVSLVGIELLAIEARV VIASVDTYLKYAEAVGLTAQAAVPAA* | 53 |
| Planktothrix-agardhii_gvpA | MAVEKVNSSSSLAEVIDRILDKGIVIDAWVRVSLVGIELLSIEARIVI ASVETYLKYAEAVGLTAQAAVPSV | 54 |
| Planktothrix-rubescens_gvpA | MAVEKVNSSSSLAEVIDRILDKGIVIDAWVRVSLVGIELLSIEARIVI ASVETYLKYAEAVGLTAQAAVPSV* | 55 |
| Pseudanabaena-galeata-PCC-6901_gvpA | MAVEKVNSSSSLAEVIDRILDKGIVIDAWVRVSLVGIELLSIEARVV IASVETYLKYAEAVGLTASAAVPAA | 56 |
| Stella-vacuolata_gvpA | MAVEKINASSSLAEVVDRILDKGVVVDAWVRVSLVGIELLAVEAR VVVAGVDTYLKYAEAVGLTAGAQTA* | 57 |
| Trichodesmium-erythraeum-IMS101_gvpA3 | MAVEKVNSSSSLAEVIDRILDKGVVVDAWIRLSLVGIELLTIEARIV VASVETYLKYAEAVGLTTLAAAPGEAAA* | 58 |
| Trichodesmium-erythraeum-IMS101_gvpA4 | MAVEKVNSSSSLAEVIDRILDKGVVVDAWVRLSLVGIELLTIEARI VIASVETYLKYAEAVGLTTLAAEPAA* | 59 |

TABLE 6-continued

Amino acid sequences of exemplary gvpA/B, gvpF, gvpF/L, gvpG, gvpJ,
gvpK, gvpL, gvpN, gvpV, gvpW, gvpR, gvpS, gvpT, and gvpU proteins

| Species, protein; | Amino acid sequence | SEQ ID NO.: |
|---|---|---|
| Tolypothrix-sp.-PCC-7601_gvpA1 | MAVEKTNSSSSLAEVIDRILDKGIVVDAWRVSLVGIELLAIEARIV IASVETYLKYAEAVGLTQSAAVPA* | 60 |
| Tolypothrix-sp.-PCC-7601_gvpA2 | MAVEKTNSSSSLAEVIDRILDKGIVVDAWRVSLVGIELLAIEARIV IASVETYLKYAEAVGLTQSAAVPA* | 61 |
| Halo-family-consensus_gvpA | MAQPDSSSLAEVLDRVLDKGVVVDVWARXSLVGIEILTVEARVV AASVDTFLHYAEEIAKIEQAELTAGAEA-XPAPEA | 62 |
| Halobacterium-salinarum_gvpA1 | MAQPDSSGLAEVLDRVLDKGVVVDVWARVSLVGIEILTVEARVV AASVDTFLHYAEEIAKIEQAELTAGAEAAPEA | 63 |
| Halobacterium-salinarum_gvpA2 | MAQPDSSSLAEVLDRVLDKGVVVDVWARISLVGIEILTVEARVVA ASVDTFLHYAEEIAKIEQAELTAGAEAPEPAPEA | 64 |
| Halobacterium-salinarum-NRC-1_gvpA1 | MAQPDSSGLAEVLDRVLDKGVVVDVWARVSLVGIEILTVEARVV AASVDTFLHYAEEIAKIEQAELTAGAEAAPEA* | 65 |
| Halobacterium-salinarum-NRC-1_gvpA2 | MAQPDSSSLAEVLDRVLDKGVVVDVWARISLVGIEILTVEARVVA ASVDTFLHYAEEIAKIEQAELTAGAEAPEPAPEA* | 66 |
| Haloferax-mediterranei-ATCC-33500_gvpA | MVQPDSSSLAEVLDRVLDKGVVVDVWARISLVGIEILTVEARVVA ASVDTFLHYAEEIAKIEQAELTAGAEAAPTEA* | 67 |
| Halogeometricum-borinquense-DSM-11551_gvpA | MAQPDSSSLAEVLDRVLDKGVVVDVWARVSLVGIEILTVEARVV AASVDTFLHYAEEIAKIEQAELTATAEAAPTEA* | 68 |
| Halopenitus-persicus-strain-DC30_gvpA | MAQPDSSGLAEVLDRVLDKGVVVDVWARVSLVGIEILTVEARVV AASVDTFLHYAEEIAKIEQAELTAGAEAAPEA | 69 |
| Haloquadratum-walsbyi-C23_gvpA | MAQPDSSSLAEVLDRVLDKGIVVDTFARISLVGIEILTVEARVVVA SVDTFLHYAEEIAKIEQAELTAGAEA* | 70 |
| Halorubrum-vacuolatum-strain-DSM-8800_gvpA | MAQPDSSSLAEVLDRVLDKGVVVDVYARLSLVGIEILTVEARVVA ASVDTFLHYAEEIAKIEQAELTAGAEAAPTEA* | 71 |
| Halopiger-xanaduensis_gvpA1 | MAQPQRRPDSSSLAEVLDRILDKGVVIDVWARISVVGIELLTIEAR VVVASVDTFLHYAEEIAKIEQATAEGDLEELEELEVEPRPESSPQSA AE* | 72 |
| Natrialba-magadii-ATCC-43099_gvpA | MAQPQRRPDSSSLAEVLDRVLDKGVVIDIWARVSVVGIELLTVEA RVVVASVDTFLHYAEEIAKIEQATAEGDLEDLEELEVEPRPESSPKS ATE* | 73 |
| Natrinema-pellirubrum-DSM-15624_gvpA1 | MAQPQRRPDSSSLAEVLDRVLDKGVVIDVWARISVVGIELLTIEAR VVVASVDTFLHYAEEIAKIEQATAEGDLDELEELEVEPRPESSPKS AE* | 74 |
| Natronobacterium-gregoryi-SP2_gvpA1 | MAQPQRRPDSSSLAEVLDRILDKGVVIDVWARVSVVGIELLTIEAR VVVASVDTFLHYAEEIAKIEQATAEGDLEDLEELEVEPRPESSPQS ATE* | 75 |
| Methanosaeta-thermophila_gvpA1 | MVTSTPDSSSLAEVLDRILDKGIVVDVWARVSLVGIEILTVEARVV VASVDTFLHYSEEMAKIEQAAIAAAPSA* | 76 |
| Methanosaeta-thermophila_gvpA2 | MVTSTPDSSSLAEVLDRILDKGIVVDVWARVSLVGIEILTVEARVV VASVDTFLHYSEEMAKIEQAAIAAAPGVPA* | 77 |
| Methanosarcina-barkeri-3_gvpA1 | MVSQSPDSSSLAEVLDRILDKGIVVDVWARVSLVGIEILAIEARVV VASVDTFLHYAEEITKIEIAAKEEKPAIAA* | 78 |
| Methanosarcina-vacuolata_gvpA1 | MVSQSPDSSSLAEVLDRILDKGIVVDTWARVSLVGIEILAIEARVV VASVDTFLHYAEEITKIEIAAREEKPVIAA* | 79 |
| Methanosarcina-vacuolata_gvpA2 | MVSQSPDCSSLAEVLDRILDKGIVVDTWARVSLVGIEILAIEARVV VASVDTFLHYAEEITKIEIAAREEKPVIAA* | 80 |

TABLE 6-continued

Amino acid sequences of exemplary gvpA/B, gvpF, gvpF/L, gvpG, gvpJ, gvpK, gvpL, gvpN, gvpV, gvpW, gvpR, gvpS, gvpT, and gvpU proteins

| Species, protein; | Amino acid sequence | SEQ ID NO.: |
|---|---|---|
| Haladaptatus-paucihalophilus-DX253_gvp A | MVQAEPNSSSLADVLDRILDKGVVIDVWARISVVGIEVLTVEARV VVASVDTFLHYAKEMAKLERASSEDEIDFEQVEVASPEASTS* | 81 |
| Mega-family-consensus_gvpA | MSIQKSTXSSSLAEVIDRILDKGIVIDAFARVSXVGIEILTIEARVVIA SVDTWLRYAEAVGLL-D-VEE-GLP-RX- | 82 |
| Bacillus-megaterium_gvpA | MSIQKSTDSSSLAEVIDRILDKGIVIDAFARVSLVGIEILTIEARVVIA SVDTWLRYAEAVGLLTDKVEEEGLPGRTEERGAGLSF* | 83 |
| Bacillus-megaterium_gvpB | MSIQKSTNSSSLAEVIDRILDKGIVIDAFARVSVVGIEILTIEARVVIA SVDTWLRYAEAVGLLRDDVEENGLPERSNSSEGQPRFSI* | 84 |
| Serratia-family-consensus | MAKVQKSTDSSSLAEVVDRILDKGIVIDAWXKVSLVGIELLSIEAR VVIASVETYLKYAEAIGLTAXAAAPA* | 85 |
| Burkholderia-sp-Bp5365_gvpA1 | MAKVQKSTDSSSLAEVVDRILDKGIVIDVWAKVSLVGIELLSIEAR VVIASVETYLKYAEAIGLTATAAAPTA* | 86 |
| Desulfobacterium-vacuolatum-DSM-3385_gvpA | MAKVQKTTDSSSLAEVVDRILDKGIVVDAWAKISLVGIELISIEAR VVIASVETYLKYAEAIGLTAAAAAPA* | 87 |
| Desulfomonile-tiedjei-DSM-6799_gvpA1 | MAKIAKSTDSSSLAEVVDRILDKGIVIDAWAKVSLVGIELLSVEAR VVIASVETYLKYAEAIGLTASAAAPA* | 88 |
| Isosphaera-pallida-ATCC-43644_gvpA1 | MAKVTKSTDSSSLAEVVDRILDKGIVIDAFAKVSLVGIELLSVEAR VVIASVETYLKYAEAIGLTASAATPA* | 89 |
| Lamprocystis-purpurea-DSM-4197_gvpA1 | MAKVANSTDSSSLAEVVDRILDKGIVIDAWIKVSLVGIELLAIEARI VIASVETYLKYAEAIGLTAPAAAPA* | 90 |
| Lamprocystis-purpurea-DSM-4197_gvpA2 | MAKVANSTDSSSLAEVVDRILDKGIVIDAWLKVSLVGIELLAVEA RVVIASVETYLKYAEAIGLTAPAAAPA* | 91 |
| Legionella-drancourtii-LLAP12_gvpA1 | MAKVQKSTDSSSLAEVIDRILDKGIVIDVWAKVSLVGIELLSIEARV VIASVETYLKYAEAIGLTATASHPA* | 92 |
| Psychromonas-Ingrahamii_gvpA1 | MANVQKTTDSSGLAEVIDRILDKGIVIDAFVKVSLVGIELLSIEARV VIASVETYLKYAEAIGLTASAATPA* | 93 |
| Psychromonas-Ingrahamii_gvpA4 | MANVQKSTDSSGLAEVVDRILEKGIVIDAFVKVSLVGIELLSIEARV VIASVETYLKYAEAIGLTASAATPA* | 94 |
| Serratia-39006_gvpA1 | MAKVQKSTDSSSLAEVVDRILDKGIVIDAWVKVSLVGIELLSIEAR VVIASVETYLKYAEAIGLTASAATPA* | 95 |
| Thiocapsa-rosea-strain-DSM-235-Ga0242571-11_gvpA1 | MAKVANSTDSSSLAEVVDRILDKGIVIDAWVKVSLVGIELLAIEAR VVIASVETYLKYAEAIGLTAPAAAPA* | 96 |
| Other gvpAs | | |
| Bradyrhizobium-oligotrophicum-S58_gvpA1 | MAIEKATASSSLAEVIDRILDKGVVIDAFVRVSLVGIELLSIELRAV VASVETWLKYAEAIGLVAQPMPA* | 97 |
| Desulfotomaculum-acetoxidans-DSM-771_gvpA1 | MAVKHSVASSSLVEVIDRILEKGIVIDAWARVSLVGIELLAIEARV VVASVDTFLKYAEAIGLTKFAAVPA* | 98 |
| Octadecabacter-antarcticus-307_gvpA1 | MAVNKMNSSSLAEVVDRILDKGVVIDAWVRVSLVGIELIAVEAR VVIAGVDTYLKYAEAVGLTAEA* | 99 |
| Octadecabacter-arcticus-238_gvpA1 | MAVSKMNSSSSLAEVVDRILDKGVVIDAWVRVSLVGIELIAVEAR VVIAGVDTYLKYAEAVGLTAEA* | 100 |
| Pelodictyon-luteolum-DSM-273_gvpA1 | VVDAWVRMSLVGIELLAIEARV VVASVETYLKYAEAIGLTAKAA* | 101 |

TABLE 6-continued

Amino acid sequences of exemplary gvpA/B, gvpF, gvpF/L, gvpG, gvpJ, gvpK, gvpL, gvpN, gvpV, gvpW, gvpR, gvpS, gvpT, and gvpU proteins

| Species, protein; | Amino acid sequence | SEQ ID NO.: |
|---|---|---|
| Pelodictyon-luteolum-DSM-273_gvpA2 | MAVEKTIGSSSLVEVIDRILDKGVVVDAWVRVSLVGIELLAIEARV VVASVETYLKYAEAIGLTAKAA* | 102 |
| Pelodictyon-phaeoclathratiforme_gvpA1 | MSVEKTIGSSSLVEVIDRILDKGVVVDAWVRVSLVGIELLAIEARV VVASVETYLKYAEAIGLTAKAA* | 103 |
| Rhodobacter-capsulatus-SB-1003_gvpA1 | MAIEKSLASASIAEVIDRVLDKGIVVDAFVRISLVGIELLAIELRAV VASVETWLKYAEAIGLTVDPQTP* | 104 |
| Rhodobacter-sphaeroides_gvpA1 | MAIEKSVASASIAEVIDRILDKGVVIDAFVRVSLVGIELIAIEVRAVV ASIETWLKYAEAVGLTVDPATT* | 105 |
| gvpF | | |
| Anabaena-flos-aquae_gvpF | MSIPLYLYGIFPNTIPETLELEGLDKQPVHSQVVDEFCFLYSEARQE KYLASRRNLLTHEKVLEQTMHAGFRVLLPLRFGLVVKDWETIMS QLINPHKDQLNQLFQKLAGKREVSIKIFWDAKAELQTMMESHQDL KQQRDNMEGKKLSMEEVIQIGQLIEINLLARKQAVIEVFSQELNPF AQEIVVSDPMTEEMIYNAAFLIPWESESEFSERVEVIDQKFGDRLRI RYNNFTAPYTFAQLDS* | 106 |
| Ancylobacter aquaticus strain UV5_gvpF | MSATLSAPGTANVAVEATAAADGKYLYGIIEAPAPATFDVPAIGG RGDVVHTIALGRLAAVVSNSPRIDYDNSRRNMLAHTKVLEAVMA RHTLLPVCFGTVGSDAEVIIEKILRERRDELAGLLGQMHGRMELGL KASWREEIIFEEVLAENPAIRKLRDALVGRSPDQSHYERIQLGERIG QALQRKRQDDEERILERVRPFVHKTRLNKLIGDRMVINAAFLVDA AVESRLDASIRAMDEEWGGRLAFKYVGPVPPYNFVTITIHW* | 107 |
| Aphanizomenon flips-aquae NIES-81_gvpF | MNTGLYLYGIFPDPIPETVDLQGLDKQSVHSQVVDGFSFLYSDAC QEKYLASRRNLLTHEKVLEQAMHEGFHVLLPLRFGLVVKDWETI QKQLIEPYKEQLNELFQKLAGQREVSIKILWDSKSELQAMMESNQ DLKQQRDNMEGKKLKMEEIIQIGQLIESNLAARKQTVIQEFFNNLH PLAKEIIESEPMTEEMIYNAAFLIPWETESVFSERVEAIDRKFGDRL RIRYNNFTAPYTFAQLAS* | 108 |
| Aphanothece halophytica (strain PCC 7418)_gvpF | MAEGFYLYGIFPPPGPQTIAVQGLDKQPIFSHTVEGFTFLYSEAQQS RYLASRRNLITHTKVLEEAMEQGFRTLLPLQFGLVVDWESVSQD LLQHQSETLQLLFQRLEGKREVSLKIYWETDAELNALLEENPDLK ARRDNLEGKNLSMDEVIQIGQALEQAMERRKQEVITRFEDALIPFA VETQENDVLTETMIYNTAFLIPWESEPEFGEAVETVDAEFAPRLKI RYNNFTPPYNFVELRE* | 109 |
| Aquabacter spiritensis strain DSM 9035_gvpF | MMQTDTLAPAETVAEGKYLYCLIDAPAPDTFASPGIGGRGDVVHT ITVGRLAAVVSDSPRIEYENSRRNMMAHTKVLEEVMARHTMLPV CFGTVATGPDPISGKILEGRRDELVGLLEQMRGRLELGLKATWRE DVIFAEILQENPAIAKLRDSLVGRSPEKSHFERIRLGEMIGQAMERK RRDDEERILERVRPFVHKTKLNKPIGDRMILNAAVLVEAAREAGL DQAVRQMDAEWGARLSFKYVGPVPPYNFVTITIHW* | 110 |
| Bacillus-megaterium_gvpF | MSETNETGIYIFSAIQTDKDEEFGAVEVEGTKAETFLIRYKDAAMV AAEVPMKIYHPNRQNLLMHQNAVAAIMDKNDTVIPISFGNVFKSK EDVKVLLENLYPQFEKLFPAIKGKIEVGLKVIGKKEWLEKKVNEN PELEKVSASVKGKSEAAGYYERIQLGGMAQKMFTSLQKEVKTDV FSPLEEAAEAAKANEPTGETMLLNASFLINREDEAKFDEKVNEAH ENWKDKADFHYSGPWPAYNFVNIRLKVEEK* | 111 |
| Bradyrhizobium oligotrophicum S58_gvpF | MSNQPIYVYGLIRAEDHQPLAVRAVGDSEQPVNIIGSGNVAALVST IDLPEIMPTRRHMLAHTKVLEAAMANGPVLPMRFGIIVPNPATLLR VIGFRHQELRARLDEIDGRIEVALKASWDEQFMWRQLASEHPDLA VSGRTMMGRGEQQSYYDRIELGRAIGAALEERRTAARLQLLQTVT PFAVQVKELTPVDDAMFAHLALLVEKGAEPSLYQTVEALERSNDS GLKFRYVAPIPPYNFVAVTLDWEQHEQAPRR* | 112 |
| Burkholderia thailandensis sp. Bp5365 strain MSMB43_gvpF | MNSRNGARYLYAVQHARDVPASLPAGIGGAAVRALTDGDVAAIV SDTGLAKVRPERRHLLAHHTVIQSLAAAGTVLPVAFGTIATSEVAL RRMLRKHRNALAGELARLVDHVEMSVRLNWDVTDLFRHLIDVRP DLKAARDAMLALGSAVTRDDKIELGSRFERVLNEERARHAALVD EALDACCKEIRRDPPRHETEILHLTCLVRHAELGRFESGVAAASRE LDDSLVLKYSGPCPPHHFVNLNMSL* | 113 |

TABLE 6-continued

Amino acid sequences of exemplary gvpA/B, gvpF, gvpF/L, gvpG, gvpJ, gvpK, gvpL, gvpN, gvpV, gvpW, gvpR, gvpS, gvpT, and gvpU proteins

| Species, protein; | Amino acid sequence | SEQ ID NO.: |
|---|---|---|
| Chlorobium luteolum DSM 273_gvpF1 | MERDGKYIYCIIGADCECDFGPIGIGGRGDLVSTIGFEGISMVVSDH PLNRFVVDPDGILAHQRVIEAVMKEHESVIPVRFGTVAATPDEIRN LLDRRYGELSELLLRLRNKVEFNVTGRWHDMAAIYKEVERTHPEI KEQRARIESMRDGDGEALKQSLILDTGHQIEAALEVMKEEKFDAV ASLFRKTAMASKMNRTTSPDMFMNAAFLIDRGREVEFDGIMEILG QKDADRCDYRYSGPLAIFNFVDLRILPEKWEL* | 114 |
| Chlorobium luteolum DSM 273_gvpF2 | MAHEAAEQDGLYIYGIINNSGELDFGPIGIGGREERVYAVIHNDIA AVVSRTVVKEFEPRRANMIAHQKVLEAVMVSHAVLPVRFSTVSPG HDDMKVEKILEEDYLRLKKLLVKMEGKKEMGLKVMANEEKVYE SIITGYDNIRYLRDKLINLPPEKTHYQRVKIGELVAAALEKEVGTY KDAVLDALSPIAEEVKVNDSYGSMMVLNAAFLIRTAREEEFDRAV NALDDRYHDMMTFKYVGTLPPYNFVNISINIKGR* | 115 |
| Chlorobium luteolum DSM 273_gvpF3 | MNQSIYIYGIVNEPALAASFVETDPDIYAVASMGCSAIVENRPAIDL GELDRESLARMLLQHQQTLERLMESGMQLIPLKLGTFVSSAADAA CIIEDGYNLIERIFRETEDAHELEVVVKWSSFADLLQEVVSEGDVQ ELKREVEARQSSSTEDAIAVGRLIKEKIDRRNAALSASVLRQLGER ASQSKRHETMDDEMVLNAAFLVNRGDVDAFVATVEALDSQYLN ALHFRIVGPLPCYSFYTLEVTALFEEFIAEKRAVLGLDARSCEADV KKAYHAKAKVAHPDVHVPAGANNGADFTVLNEAYMTLHDYYS ALRNSASSRHGHEGQDSSSVVFSVKILN* | 116 |
| Dactylococcopsis salina PCC 8305_gvpF | MTEGFYLYGIFPPPGPKTIETQGLDKQPIFSHTVEGFTFLYSEAQQS RYLASRRNLITHTKVLEEAMENGSRTLLPLQFGLIVPDWETVVQD LLQHQAESLHFFLEKLEGKREVSLKIYWETNAELNALLEENPALK ARRDNLEGKQLSMDEVIQIGQALEQEMEGRKQDIISRFEEVLIPFAF EIKENDVLTETMIYNTAFLINWDAESDFGEQLEAIDAEFSPRLKIRY NNFTPPYNFVELRE* | 117 |
| Desulfobacterium vacuolatum_DSM 3385_gvpF | MSKKNLKRNGRYLYAIIEASEEKTFGSIGMDGSDVYLIVEDKTAA VVSDVPNKKIRPQRKNIAAHHAVLNKIMEEITPLPMAFGIIADGEQ AIRKILADNRDVFREQFATVSGKVEMGMRISYDVPNIFEYFISTDSE IRAARDQYFGGNREPSQEAKLELGRMFNRQLNANREEYTNQVIEI LDDYCDDIKENKCRNEQEVTSLACLINRSDQKRFEEGVFESARHFD NNFSFEYNGPWSPHNFVNILIEL* | 118 |
| Desulfomonile tiedjei DSM 6799_gvpF | MEKATIKTTGSNGRYLYAVVPGSQERVYGCLGINGGNVYTIAAKD VAAVVSDVPHQKIRPERRHFAAHQAVLKRVMLDGDLLPMSFGIIS QGPKAVRAILSRNNKSVQQQLKRISGKAEMGIKVTWDVPNIFEYFI DVNRELREARNKLVQPNYLPTQQEKIEIGRMFEEILNLERERHTKQ VERVMSKRCSEIKRSKCRTEIEVMNLSCLVDRTLLSDFEAGVLEAA SHFDDSFAFDFNGPWAPHNFVDLEIDV* | 119 |
| Desulfotomaculum acetoxidans_DSM 771_gvpF1 | MSTGRYVYCVINSIEPLTFMSGPVGNEPEGVFTVHYKELAAVVSQ SSEEKYNVCRENTIAHQKVLEEVLVSHPLLPVRFGTVAQNEEIVKK FLLQERYAELRSMLHNVTGKVQMGLKVLWTDMKTVYQEIVEENP QIKNLKKKLESKPAETIHYEMIDLGQMVNQALLRKKEKQKEMVL KPLQKIALETKESFLYGDQMFVNADFLISRSSLDDFNAKVNELGEF FNEQALFKYIGPLPPYNFVTLYVNF* | 120 |
| Desulfotomaculum acetoxidans_DSM 771_gvpF2 | MVKNHNTDHLKELYIYGLIGGTPFKDELEKISVIQENTPIYGVWHK NIGFAVSAAPDYPLKDLSKESIIQLFVDHQQVLECLRQKFSLIPVKL GTVLESVTEAAAVLANNEEKFNDLLNYLKDKVELNLSVSWNDLN EVVAKIGEEDEVKKLKQSLLAQEQVSQEDLIKIGKIISFQMQQKKQ AAREYIISELRNLWEDYFINEVVDENSILNLTLLAITGKVDDVNKKI EYLNQIYRDSLDFSLTKSLLPQGFSTVSIKKITMDQLLLAKDILKLP DTASLQDINAARRALLHCYHPDKNDHAAVNKVQEINAAYKLLEE YCQENSSDFNVDLITDYYIMKVIKADKSNVNSMNME* | 121 |
| Dolichospermum circinale_gvpF | MNTDLAHKNFGLYLYGIFPDTIPETLEIKGLDGKSVHSQVVDGFTF LYSQACQEKYLASRRNLLAHERVLEQTMHEGFHVLLPLRFGLVV KDWETIMSQLINPHKEQLHKLFEKLAGQREVSIKILWDAKAELQA MMESNHDLRQQRDNMEGKKLSMEEVIQIGQLIESNLQARKQAVIE VFTRELNPLAQEIVVSEPMTEEMIYNAAFLIPWDSEPLFSERVESID QKFGNRLRIRYNNFTAPYTFALLDS* | 122 |

TABLE 6-continued

Amino acid sequences of exemplary gvpA/B, gvpF, gvpF/L, gvpG, gvpJ, gvpK, gvpL, gvpN, gvpV, gvpW, gvpR, gvpS, gvpT, and gvpU proteins

| Species, protein; | Amino acid sequence | SEQ ID NO.: |
|---|---|---|
| Enhydrobacter aerosaccus strain ATCC 27094_gvpF | MNPPEAYIAGRTAAKSVEDRKARPQDLAEGKYVYAIIACDEPREF KNRGIGERGDKVHTINHRQMAAVVSDSPTIDYERSRRNMMAHTV VLEEVMKEFDLLPLRFGTVASSAESVERQLLVPRYGELSAMLEKM RGRSEFGLKAFWHEGVAFGEIVRENARVRKLRDALQGRSLEESYY QRIQLGEEVEKALTAIRARDEELILSRLRPFMRDIRTNKIISDRMVL NAAFLVERGDVPALDEAIRQLDQEFSERLMFKYVGPVPPYNFVNI AINWER* | 123 |
| Isosphaera pallida_ATCC-43644_gvpF | MRNAPPTRPGSVTPASPGKPVIDGPARYLYAFTHDLPEGPLADLEG LPGARVVVVADGRVAAVVSPCPLGKVRPERQRVAGHHHVLKHL QDTLGKAILPASFGMVADSEEDLRALLRHHSAAIAEGLVRVQGKV EMTVKLRWAPDNVAQAVLGRDPELRQLRDQLYSNGQTPTRDQSL DLGRRFHHALERQRDHYAAYLRAALSPLLSELVEEDLRDERDLVH WACLIENQRRAGFEAALDRLAEELEDDLVLELTGPWPPHHFVDLD LDDDHDDDEEE* | 124 |
| Legionella drancourtii LLAP12_gvpF | MDSTSKKPAASNLYLYAIASVNENQEPISFHGIEEQPIDLVPYKDIM LVVSNLSKKKVRPERKNVAVHHAVLNHLMKHNTSMLPIRFGMIA DNRKEVQRLLTINYDMLHTKLKMMAGRVEMGVSLSWDVPNIFEY LLNRHSQLRETRDKLLANPAHEPSRDEKIEIGALFSQILDEEREVYT DTILSLLSPVCCDVVKSTYRNDTEIMNIFCLISAARRDEFEEKIIEAS TILDDNFVIKYTGPWPPHNFSKLNLSLE* | 125 |
| Lyngbya confervoides BDU141951_gvpF | MPQLLYLYGIFPAPGPQDLEVQGLDQQPIHTHIIDEFVFLYSVAQQE RYLASRKNLLGHERVLEAAMKVGYRTLLPLQFGLIIETWDRVIKE LITPRGDALKRLFAKLEGRREVSVKLLWGPDAELNQLMEEDAGLR AERDRLEGQQLSMDQIVDIGQAIETAMTERKDDVINAFRQRLNAL AIEVLENDPLTDAMIYNTAYLIPWEDEVKFSQAIEELDEQFEDRLRI RYNNFTAPYNFAQLDQLS* | 126 |
| Microcystis aeruginosa NIES-843_gvpF | MTVGLYLYGIFPEPVPDGLVLQGIDNEPVHSEMIEGFSFLYSAAHK EKYLASRRYLICHEKVLETVMEAGFTTLLPLRFGLVIKTWESVTEQ LISPYKTQLKELFAKLSGQREVSIKIFWDNQWELQAALESNPKLKQ ERDAMMGKNLNMEEIIHIGQLIEATVLQRKQDIIQVFRDQLNHRA QEEVIESDPMTDDMIYNAAYLIPWEQEPEFSQNVEAIDQQFGDRLRI RYNNLTAPYTFAQLV* | 127 |
| Nostoc punctiforme ATCC 29133_gvpF | MSFYIYGILTLPAPQNLNLEGLDRQPVQIKILDDFAVIYSEAQQERY LASRRNLLSHEKVLEEIMQAGDRYLLPVQFGLLVSSWETVSQQLIR PHQEELTQLLAKLSGCREVSVKVFWDTEAEIQGLLAEHPNLKTER DKLVGQPLSMERVIQIGQVIEQGMSDRKQGIIDVFKGTLNSIAIEVV ENTPQVDTMIYNSAYLIPWEAESQFSEHVESLDRQFENRLRIRYNN FTAPYNFARLRLTTSN* | 128 |
| Nostoc sp. PCC 7120_gvpF | MSSGLYLYGIFPDPIPETVTLQGLDSQLVYSQIIDGFTFLYSEAKQE KYLASRRNLISHEKVLEQAMHAGFRTLLPLRFGLVVKNWETVVT QLLQPYKAQLRELFQKLAGRREVSVKIFWDSKAELQAMMDSHQD LKQKRDQMEGKALSMEEVIHIGQLIESNLLSRKESIIQVFFDELKPL ADEVIESDPMTEDMIYNAAFLIPWENESIFSQQVESIDHKFDERLRI RYNNFTAPYTFAQIS* | 129 |
| Octadecabacter antarcticus 307_gvpF1 | MKREVVRMTDENTINSKYLYAIIKCREQREFIARGIGERGDAVHTI AYKGLAAVVSDSPVMEYDQSRRNMMAHTAVLEELMEEFTLLPVR FNTVAPEAGAIEERLLVPRHEEFTQLLGQIDKRVELGIKAFWHDG MIFEEVLRENDSIRKMRDALEGKSVDGSYYERIQLGEKIEQAMIKK RVEDEEIILSRIRQHVHKSRSNKTIGDRMVLNGAFLVDANKESDFD KAVQLLDQDLGNRLMFKYVGPVPPYNFVNIVVNWGVV* | 130 |
| Octadecabacter antarcticus 307_gvpF2 | MTVVAEENMTGSVGLYVCAIVAEWESNSALIKCANEAQGEIQLIG QGGITAVVMVPPEDQPVSRDRQELVRQLLVHQQLVERFTEIAPVL PVKFGTLAPDRESVELGLERGREKFFTAFGGLSGKTQFEITVTWDV ADVFAKIAKLPAVVKLKVDLVATSESDRPINLDRVGRLVKETLDH QRAQTGKVLLDALLPLGVDSIVNPILNDSIVLNLALLVDTDQADAL DRCLDELDSTFHGALSFRCVGPMPPHSFATVEINYIEPTQVSHACC VLELDAAHNFEEIRSAYHRLARQTQQDIAPDVVVDNKSSSVGIAV LNDAYKTLLSFVDAGGPVVVSVQRQEDAYATDIPSSGG* | 131 |
| Octadecabacter arcticus 238_gvpF1 | MTDEKKVNSKYLYAIIQCREPRELKARGIGERGDVVHTVVHKGLA AVVSDSPVMEYDQSRRNMMAHTAVLEELMEEFTLLPVRFNTVAP EAVAIEERLLVPRHDEFTQLLGQIDKRVELGLKAFWHDGMIFGEV LRENDSIRKMRDSLKGQSVDGSYYERIQLGEKIEKALTEKRLEDEE MILSRIRPHVHKSRSNKTIGDRMVLNGAFLVDAEKESKFDEAVQSL DQDLSDRLMFKYVGPVPPYNFVNIVVNWGES* | 132 |

TABLE 6-continued

Amino acid sequences of exemplary gvpA/B, gvpF, gvpF/L, gvpG, gvpJ, gvpK, gvpL, gvpN, gvpV, gvpW, gvpR, gvpS, gvpT, and gvpU proteins

| Species, protein; | Amino acid sequence | SEQ ID NO.: |
|---|---|---|
| Octadecabacter arcticus 238_gvpF2 | MRAQKVIPAAEENISGNVGLYVCAIVAERVSCSALIQCANDAPGEI QLIGHGDFTAVVMVPEKDQLVSPDRKELMQQLLVHQQLIEKFMEI APVLPVKFATLAPNRESVELGLEVGSEKFSAAFNSLSGKVQFEVIV TWDVAEVFAEIAKEPAVAKLKVDLAAMPESYGSVSLEQLGKLVK ETLELRRAETGKVLLDALVQVGVDNVVNSILDDSIILNLALLVEAK RADAFDRCLDELDSTYHGALTFRCVGPLPPHSFATVEITYLEPAKV TEACDILELDVARSTEEVRSAYHRLARKSHPDIVPDVAVGETASVS MAVLTDAYKTLLSFVGAGGSVVVSVQRQEASYAADIISSAG* | 133 |
| Pelodictyon phaeoclathratiforme_ gvpF1 | MDIETTKEGRYIYGIIRNSEFIDFGQIGIGKRNDRVYGVIYKDICAV VSSTPIIQYEARRANMIAHQKVLEEVMKRFNVLPVRFSTISPHDND DAIIKILITDYSRFDELLIKMKGKKELGLKVMADETRIYENIIQKYD NIRSLRDKLLNQPADKIHYQRVKIGEMVADALKKEIESYKQQILDI LSPIAEDIKITDNYGNLMILNAAFLIKEVKESEFDDSVNKLDEKYGN IMTFKYVGTLPPYNFVNLSINTKGV* | 134 |
| Pelodictyon phaeoclathratiforme_ gvpF2 | MEKDGKYVYCIIASTYECNFGAIGIGGRGDLVNTIGFQGLSMVVSD HPLNHFVLNPDNILAHQRVIEVVMSQFNSVIPVRFGTVAATPDEIR NLLDRRYGELSELLERFENKVEYNLKASWRCMIDIYKEIDKEHVE LKQLRREIEGLKDEEKRKLLIVEAGHIIENELQKKKEVEAYEIVTYL RKTVVAHKHNKTTGEAMFMNTAFLLNKGREVEFDNIMNDLGEQ YKDRSDYYYTGPLPIFNFIDLRILPEKWEL* | 135 |
| Pelodictyon phaeoclathratiforme_ gvpF3 | MDRQGIYIYGFIPNHYLTDIKTILIESGIYSIEYGSIAALVSDTMVDDI EYLNREDLAYLLVDHQKKIELIMSTGCSTIIPMQLGTIVNSGNDVIK IVKNGLRIINKTFDDIADIQEFDLVVMWNNFPDLIKKKISDTPQIRMK EEIANKGSYDQADSINIGKIIKKKIDEKNSKVNLDIMNSLSSLCICVK KHESMNDEMPLNSAFLIKKDKENSFIEMVNQLDIKYENLLRYKIV GPLPCYSFYTLESKLLNKKEIEKAEKILGIDAYKSESDIKKAYRAKA AHAHPDKNNTISAIDNDDFIEINKAYQILLEYSSVFKDSPDHKPDEP FYLVKIKK* | 136 |
| Phormidium tenue NIES-30_gvpF | MADRYYLYGIFPAPGPAELPLMGLDEQVVQAQQLGDFTFLYSLAC QKRYLSSRKNLLGHEKVLEAAMEQGHRTLLPLQFGLIVESWNQV QEDLVTPYAEDLTQLFGRLNGCREVSIKVQWEPSTELEMMMAEN ADLRAQRDQLEGTQLGMEQVIFIGQQIESALEERKQGIVDQFRQAL SPLAKDVLENAPQTDVMIYNAAFLIPWESEAEFSQAVDAIDSTFGD RLRIRYNNFTAPYNFAQLN* | 137 |
| Planktothrix agardhii str. 7805_gvpF | MGNGLYLYGILPTNRVRPLALHGLDKQPIQTHPVDEFSFLYSETQQ ERYLASRRNLLGHEDVLEKVMQHGYRSVLPLQFGLIVKDWDHVK AQLIIPYQDRLKELFHKLEGKREVGVKIFWEETEELDLLMTENQEL REKRDSLEGKRLSMDEIIGIGQEIERAMQDRQQGIIDKFQQILNPLA QEIVENDNLTSAMIYNAAYLIPWDIEPQFGDKIEELDHHFNNRLRIR YNNFTAPFNFAQLNP* | 138 |
| Psychromonas ingrahamii 37_gvpF | MAENKKKVRKSSSKVIAKPKVIYAITAGGLQDLGNLVGINKSDIYT IEKESISFVVSDLSPSSPRPRPDRRNIMAHNEILKQLMSKTSVLPVRF GTVATGERAVNRFCSQYNAQLLEQLDRVQDRVEMGIKVTWNVP NIYDYFVDNHSELREERDRVYDGNKNPRRDDRINLGHMYDALVT EARLSHQTDLEEIILPGCDEIHSIPPKDEKVVVNLACLVQRADLEVF EERVVEAGKTLDNTYDIELNGPWAPHNFVELDLKTMTGRR* | 139 |
| Serratia sp. ATCC 39006_gvpF | MMSIDKSRNHRAKVLYALCVSDDSTPNYKIRGLEAAPVYSIDQDG LRAVVSDTLSTRLRPERRNITAHQAVLHKLTEEGTVLPMRFGVIAR NAEAVKNLLVANQDTIREHFERLDGCVEMGLRVSWDVTNIYEYF VATYPVLSETRDEIWNGNSNANNHREEKIRLGNLYESLRSGDRKE STEKVKEVLLDYCEEIIENPVKKEKDVMNLACLVARERMDEFAKG VFEASKLFDNVYLFDYTGPWAPHNFVTLDLHAPTAKKKTLTRAG TLSD* | 140 |
| Stella vacuolata_ATCC-43931_gvpF | MQTEALAPAAVAAEGKYLYCIIDAPAPATFASPGIGGRGDVVHTL AVGRLAAVVSDTPRIEYENSRRNMMAHTKVLEEVMAHHTLLPVC FGTVGSGDDVIAEKILEGRREELSRLLEEMRGRVELGLKATWREE VIFAEVLDEDPAVRKLRDSLVGRSPEKSHFERIRLGELIGQALLRKR RDEEERILDRVRPFVRKTKLNKPIGDRMILNAAFLVETAREAALDQ SVREMDADWGARLSFKYVGPVPPYNFVTITIHW* | 141 |

TABLE 6-continued

Amino acid sequences of exemplary gvpA/B, gvpF, gvpF/L, gvpG, gvpJ, gvpK, gvpL, gvpN, gvpV, gvpW, gvpR, gvpS, gvpT, and gvpU proteins

| Species, protein; | Amino acid sequence | SEQ ID NO.: |
|---|---|---|
| Thiocapsa rosea strain DSM 235 Ga0242571_11_gvpF | MQQAKRQDVAAGRYIYAIIPDRGDHSLGRIGLDESEVYTIGDGRV AAVVSDLSGGRIRPQRRNMAAHQEVLKQVLREVSPLPAAFGLMA DDEAAIIRILKDNQDAFLNQLERVDGSLEMGLRMSWDVPNIFEYF VGAHPELQELRDDFFRDGSNLTQDQMITLGRSFERLLEQDREEYTE QVESVMRSCCREIKRNKCRTEKEVLHLACLVDRDAAGRFEQVVL QAARPFDNNYAFDFNGPWAPHNFVEMDIHV* | 142 |
| Tolypothrix sp. PCC 7601_gvpF | MDAGLYLYGIFSDPIPPTVSLKGLDSQPVYSQVIEGFTFLYSDAKQE KYLASRRNLISHEKVLEQAMQEGFRTLLPLRFGLVVKNWETVISQ LIQPCERQLRDLFQKLAGKREVSVKILWDTKAELQAMMQSNPDL KQKRDQMEGKNLSMEEVIEIGQLIESNLQQRKEAVIKTFFDELKPL AEEVVESEPMMEEMIYNAAFLIPWDQEALFSQRVEAIDKKFGDRL RIRYNNFTAPYTFAQIS* | 143 |
| Trichodesmium erythraeum IMS101_gvpF | MEFGFYVYGLIQEKGKMDESKDESKNGLKGSNESKDELKGLDKE DVKIQDVDEFAVLYSIAKKERYLASRRNLITHEKVLESAMEAGYR NLLPMQFGLVVSEWEKFSQDFTKPCEQQIHDLFTKLKNNREVGIKI YWEPDAELEKLLENDKDLKEERDSLKDKKLTMDQVIDIGQKIEQG MNERKQNIIEIFQETLNKMAIEVIENEVQTEKMIYNAAYLIPWDQE EDFGEKVETIDSKLCERGNFTIRYNSFTAPYNFARIRQQD* | 144 |
| gvpF/L | | |
| Ancylobacter aquaticus strain UV5_gvpFL1 | MTDLLVFAVVPADRFDPAILAEGDGLPPGLRAIAAGPLAAVVGAA PEGGLKGRERSALLPWLLASQKVMERLLANAPVLPVALGTVVED EGRVRHMLDAGAAILGEGFQAVGDGIEMNLSVLWHLDTVVARLL PGVAPELRQAAAGGDAIERQALGVVLAGLVSAERRRARARVIEAL QAVTRDFAIGEPTEPGGVVNLALLVDRAAEEALGAALEALDAEFD GALTFRLVGPLPPYSFASVQVHLSPAAAVCGARAALGVEPDASPE TVKAAYRRAARETHPDLVPMGGEDEEAPEATADETSRFVVLSDA YRVLEGEHAPVSLRRLDSVLTE* | 145 |
| Ancylobacter aquaticus strain UV5_gvpFL2 | MLYVYAITADYAAGANHLLPAKGIVPGVPVQRFGTGALGAVASP VPVTVFGKEALHALLDDDADWTRARILAHQRVVSSLLPLATVLPLK FGTLVAGEASLAAALTSQHDALDATVARLRGAREWGVKLFFEAP TRTIRAEEPVGAGAGLAFFRRKKEEQETRAAAEAALDRCVAASHR RLASHARAAVANPLQPPELHGHPGTMGLNGAYLVAAENEAAWR VCFSELEQAYAALGARYVRTGPWAAYNFTGGGLV* | 146 |
| Aquabacter spiritensis strain DSM 9035_gvpFL1 | MSGLLVFAIVPADRIEPGLLAPAEGLPPGLETVVAAGFAAIVGTAP EGGLKGRDRGSLLPWLLASQKVIERLMARGPVLPAALGSVLEDES RVRHMLVCGQAALAAAFETLNGCWQTDLSVRWDLSRTVAHLMT ELPPGLRAAAETGDETARRSLGAALAGLVAGERRRIQSRIGAVLG AVARDLIVSDPVEPEGVVGVALLVDAPASAQVDAALDRLDGEFE GRLTFRLVGPLAPYSFATVQIHLGPAAGLAGAHAELGLEAGAPLE AVKAAYHRLIVGLHPDLVPHGSPGDDADDAASGKGGRAARFAAV TAAYRTLQAEHAPVSLRRQDGLSPG* | 147 |
| Aquabacter spiritensis strain DSM 9035_gvpFL2 | MLYVYAITADHPGPHDAGSLPGEGIVPGAPVRLLPFGDLAAAVSP VSAVDFGPEALPARLQDVDWTGQRVLAHQRVVDSLVDVATVLP MKFCTLFSGAAALRAALADNRAALEATVVRLRGAREWGVKLFW EAPPAEPAPVERGPGAGAAFFQRKRDAQRLRAEAEAALAHGVAE SHRRLAARARAAVANPVQPAAVHRRRGEMALNGAYLVPRADEA AWRESLAELERTYAGAGIRYELTGPWGPYNFTGGGLAGS* | 148 |
| Bradyrhizobium oligotrophicum S58_gvpFL1 | MTMNLVGITTPDVAGAIAAAGGRLADVETRAVEAGGLVALLALS KAPFWHVLRRSRTALRSMLTAQRILEAAAVYGPLLPARPGTLIRN DAEACMLLRSQCRHLAEGLRLHGTSRQYQITISWDPVAALAARRD HQDLVEAAAASADGAADKAASMIQRFMSDQQARFEAEAMRALA AVAEDVITLPVNQPDMLMNAVVLLAPGAEPELERVLEALDRGLR GKNLIRLIGPLPPVSFAAVSIERPGRQRIAAARRLLGIGEATRTCDLR RAYLDKAHAHHPDTGGHAADASIVGAAAEAFRLLARVAEARASA GQDDVILVDIRRQDQQRSLST* | 149 |
| Bradyrhizobium oligotrophicum S58_gvpFL2 | MSKANLGIGLVHGVVTAQSAALLPQIVDAFDATEIIVVNTEQQALL ISDIPQYLRGHVEADTLFSDPARISTLAMKHHRILQAAAVVTDVVP VRLGTLVRGPSGARDLLNREAVRFAGHLVTIHNALEFSVRILPTEQ PSRRVARPVPSSGRDYLRIRRDERCGQRPAVVDITLQELASRAVAI RERQSASRSGGRTPALAEAAFLVDRHALAAFDDCAGRIERQIAEN GLALDIFGPWPAYSFVDGARENLG* | 150 |

TABLE 6-continued

Amino acid sequences of exemplary gvpA/B, gvpF, gvpF/L, gvpG, gvpJ, gvpK, gvpL, gvpN, gvpV, gvpW, gvpR, gvpS, gvpT, and gvpU proteins

| Species, protein; | Amino acid sequence | SEQ ID NO.: |
|---|---|---|
| Bradyrhizobium oligotrophicum S58_gvpFL3 | MSSPRLIGLLAADDVPADLADQIMSCGPVAAAIRFAPAAASSSESL DHHAAVVAWCRRAAFLPSRAGIPISPELLQSIARSAWYHRSTIEHIE GRVEISVELERRDGVRDGGIDGGGRAYLRATAHDLRACEVGVAT AANLLAMYSERADADLIARTAPLPAIRLRASVLVRRAVAPRLARQ FDSMLSAISDRLVCRVTGPWPPYSFSTIREPS* | 151 |
| Burkholderia thailandensis sp. Bp5365 strain MSMB43_gvpFL | MVWLTYAVLTPKRSITLPPGVAGARLEIVDGAHLRTIVSEHPRAPS ATIPSALDFGQTVAALFRHGAIVPMRFPTCLDSKQAVRDWLDDES DMYRDLLQRIDGCVEMGLRFRLPEAPRAQPRPQAGGPGHAYLAA RGAPNSVARSHGERIAAVLRNLYRDWRFDGLVEGFVSLSFLVRQT TLDDFVDRCRQAARETAFPLYMSGPWPPYSFATDERSSAPEPHRA LRLMRRPSTAVSISANVAAPEKKDSAR* | 152 |
| Desulfobacterium vacuolatum-DSM 3385_gvpFL | MTLHLLYCVFSSGEMEKTRKLVPPGIDGEPVHEICSNKISGVVSTL GKPPDTHVKSLLAYHGVIDSYHQNRTVIPMRFAAVFRTYAHMITA LNNNEKSYLLQLKRLHDCTEMCVRFISNSPCCVKKKEPAISPKKIS GTTFLQQRKAMYEQQNRLPPEIHEKTRDILQHFRGLYMEFKQESQ PLEKDCPSLSLQGAEKTDGNALLISLFFLISKKNISLFRSRFQNICGS SSGRHMMNGPWPPFNFINTESNLTDPS* | 153 |
| Desulfomonile tiedjei DSM 6799_gvpFL | MLGSLAAIQFLSISSYGADEMKFLMYCIFTENSIEPPHSLVGVNRSP VRIISCDGLAAAVSVITQKEIPRDPATGLDYHKVIQWFHERIGVIPL RLGTCLGHESDVVQLLHSHGARYKSLLKELDGCVEMGIRVIHDRP GPQELASKSPFISRFNGTESGTDYLMRRKVLFDADEFAISRNREIVE RYHSPFTGLYVSFKAQTSKFSPLGTDRNSVLTSLYFLIPRQSADSFR AIYGDLRSGLHERIMLSGPWPPYNFVLPEDCL* | 154 |
| Enhydrobacter aerosaccus strain ATCC 27094_gvpFL | MEGHRIYIYGIVRDAADGGPAPVPPVAGLDGGALRAIAGYGLAAI ASAVDLSKAGIPFEEQLKDPDRATALVLEHHRVLQQAIDAQTVLP MRFGALFQDDRGVTDALEKNRCGLMDALGRIDGAREWGVKIFCD RAVAARQLSATSAVVQAAEKELSGLAEGRAFFLRRRLERLRTEET DRAVAHEVDVSRQALCELARASAPLKLQPAAVHGRGEDMVWNG AFLVPRSGEERFLSRLEVVVQSRSDLGLHYEVTGPWPPFSFVDGQL EGGGDACPDGA* | 155 |
| Octadecabacter antarcticus 307_gvpFL | MRSATSIVYAYGVLTNCSDIALDMPRSDLAGLVKNGPLRILPFGNI AAVVCDFVLPNGSDLETLLEDSRSAERLILNHHQVLSYIVSQHTILP LRFGAAFTEDAGVIAALGGRCSELQKALGRIDGALEWGVKTFCDR KLLKQRVRGTGSEISDLESEIAKQGEGKAFFLRRRKERLILEEVEEI LEQCVVGTQEQLEPSVIEEALVKLQPPTVHGHEHDMLSNISYLIAR GTEDAFMQSLEDLRLAHAPYGLEYQMNGPWPAYSFSDQQLEGGV NDQ* | 156 |
| Octadecabacter arcticus 238_gvpFL | MSSATSIVYVYGVLTNCSDLVLDFPPGDLAGIVESGPLRILPFGDIG ALVCDFILPDGSDLKTILEDSRSAERMILNHHLVLADMVSRYTILPL RFGAVFAEDAGVIAALGGRYSTLQKELDRIDGAIEWGVKSFCNRK MFSECVAETVSEISVLEKEIADQGEGKAFFLRRRIQRLILDEVEKTL EQCLVGAQDQLKSRAIEETLVKLQPPTVHGHKHEMVSNRSYLIAR GAEDAFMQSLDDLRVVYAPFGFDYQINGPWPAYSFSDQQLGGGV NDK* | 157 |
| Rhodobacter capsulatus SB 1003_gvpFL1 | MGHYLYGLLAPPARGTLAQMQAAAAGVTSLGGPVALSAVEGML LVHCPCDLAEISQTRRNMLAHTRMLEALMPLATCLPVRFGVIAQD LAEVARMIHERRAELVGHAQRLLDPVEIGLRVRFPRDRALAQLMA ETPDFVAERDRLMGQGAGAHFARADFGRRLAEALDARRTRDQKR LLAALRPHVRDHVLRAPEEDVEVLRAEFLIPAAGVDAFSRIAHDLA AALGFAGAAEPELQVIGPAPPYHFLSLSLAFDNTSEAA* | 158 |
| Rhodobacter capsulatus SB 1003_gvpFL2 | MAHEIIAILPCEAAQLPSGLTGVVGRGATAVLAPAPGWAERLTGG PKQTAVRHHSRLEALMAMGSVLPFAAGIACTPEEAALLLRLDAPLI ARLAAEIGPRRHFQLALDWDESRVLAAFRDSPELAPLFSGAAVTPE ALRQAITALADRLSATALRLLDPVAEDPVEQPRAPGCLLNLVFLLR PEDEPRLDAALQAIDALWSEGLRLRLIGPSAPISHALVDIDRADVA ALAAAADLLKVAPEAGPEAVTEAAKAALRSPDLAANAAEQIRAA ARLLLRAGDIAALGLSGAATLPHLVHLRPGGRKSGLTSSGEAA* | 159 |
| Rhodobacter capsulatus SB 1003_gvpFL3 | MTGLALHGFVSPDGWSAAAAPPARCAVVLGGVAALVSEAGDAL DTPETAQAAALAHHALISAWHRRGPVLPVRLGTVFSSQAALQTAL APKAAQLRAALDALADKEEMVLTIVPAARPPDLPPPAATGADWL RARKAVRDRGQARQTDRQQTLAGLQDALRAQGVASLAAPAPRE GGSRWHLLIARDDGAGLDRWLAAQADRFDAAGLDLTLDGPWPP YRFAAEILEALDG* | 160 |

TABLE 6-continued

Amino acid sequences of exemplary gvpA/B, gvpF, gvpF/L, gvpG, gvpJ, gvpK, gvpL, gvpN, gvpV, gvpW, gvpR, gvpS, gvpT, and gvpU proteins

| Species, protein; | Amino acid sequence | SEQ ID NO.: |
|---|---|---|
| Rhodobacter capsulatus SB 1003_gvpFL4 | MSEPRISGLAPWRADLPDVIGCHGGWVLMGAAADETPEARLRRQ VGWCRAAVDVLPLSPRLAPTRAEAERLVATRGPDLERAHRHIRGR LQVIVQLEMCRTDLGLVRREISGGRSWLQDRAERATREARANADF EAQVRRVVRALFPREGQVVTLAPSGTAGQLRLRRAVLVPRAGLQ AFAAALSADLDRDGRGGLWDVIAPLPPLAFAALEAGPGGAVT* | 161 |
| Rhodobacter sphaeroides 2.4.1_gvpFL1 | MIYLYGLLEEPASGHEVLAGMAGVTGPIALARLPGGILIYSSATEA DILPRRRLLLAHTRVLEAAAWFGNLLPMRFGMMASTLAEVAAML ASRLTELCAAFDRVRGRVELGLRLSFPREPALAATLATAPDLAAER ARLLALRRPDPMAQAEFGRRLAERLDARRGETQRLLFQSLRPLWV DHRLRVPDSDVQVIAVDVLVEDGAQDRLAAALVKAAADCSFAPT AEPSVRVIGPVPLFNFVDLVLSPRREEVA* | 162 |
| Rhodobacter sphaeroides 2.4.1_gvpFL2 | MRLREVVAVLEGHPPSVLPEGTEAICEAGLTAILGMPPGLLSGRRA LLEHAACRQAVLERLMAFGTVLPVLTGNCLTPAEAAAALAANSP RLRQELRRLAGRVQFQVLVQWHAALVPKRTDPDETAEDLRLRFT HRIADALARVAERHVNLPLREDMLANQALLLLQTRTDDLDRSLEQ IDALWTEGLRIRRIGSPPVSFASLNFRRVSSAAIRRARHRFDLEGP VDPIRLRALRRDLLLRASEAERAEILAAAAVLDLLTRCAASGGDLH LVRIWSEGQAVPSDLEDAA* | 163 |
| Rhodobacter sphaeroides 2.4.1_gvpFL3 | MSGLLLLGVVSGLGISPAITSPHLRLDGDGYAAILLSLDRLPPDPAS PDWAVQAALAQNAILSAYAATEDVLPVALGAAFTGIAAVKRHLD AERATLDAGMERLAGRAEYVAQLIAEQVADGAAPAPASGSAFLK ARSARHEQRRHLARERTGFARATAEELASLSCSASARPLKPDGPLL DLSLLVARDRVPGLLEAAEASSRAGSRLALSVRLIGPCAPFSFLPET RGHD* | 164 |
| Rhodobacter sphaeroides 2.4.1_gvpFL4 | MAGDARSRVRLHLAAMRDCETFLPFPPAATIAVDEAIAWCGRRTN ALAEEIDRFSRQRQLTVSARLIAPLLPDAAASGAGWLRARRDASA HQARLRTVLMQIMSLLGEVRCIPGRLQDEVQVNLLVPAAETHPVL HELRERLRVGDALWSACTVTGPWPPYAFISWETA* | 165 |
| Rhodococcus hoagii 103S_gvpFL1 | MSEQESAPDGGGPVVYVYGLVPADVEVKEDATGIGSPPRPLKIVH HEDVAALVSEIDPDTPLGSSDDLRAHAAVLDSTATVAPVLPLRFG AVLTDTDAVVAELLEPYRDEFHEALEQLEGKVEFVVKGKYVEDAI LREILADDPEAARLRDVVREQPEDTTRDERLALGERISQALTAKRE QDTGRIVEALQPAATAVAPREPTDDEEAGSVAVLISADGVDELDK AVARLIDDWQGRVEVTVTGPLAAYDFVKTRAPGT* | 166 |
| Rhodococcus hoagii 103S_gvpFL2 | MTPDDGVWVYAVTGDGSFPGGISGIRGVAGEELRTVTDSGFTAVV GTVRLDTFGEEALRRNLEDLDWLADTARRHDAVVAAICAGGATV PLRLATVYFDDDRVRTMLRDNAEQLGEALQQIADRSEWGVRAYL ERPRSEPRDAREKTGRPSGTAYLMQRRAQVAAREQAESAAGRRA DIFAELARWAVAGVRQPPSPPDLAGRRSQEILNTSFLVDNGRHRE FVTAVEELDARLSDVDLVLTGPWPPYSFTSVEASAR* | 167 |
| Serratia sp. ATCC 39006_gvpFL | MSLLLYGIVAEDTQLALEPDGSPHAGEEPMQLVKAATLAALVKPC EADVSREPAAALAFGQQIMHVHQQTTIIPIRYGCVLADEDAVTQH LLNHEAHYQTQLVELENCDEMGIRLSLASAEDNAVTTPQASGLDY LRSRKLAYAVPEHAERQAALLNNAFTGLYRRHCAEISMFNGQRTY LLSYLVPRTGLQAFRDQFNTLANNMTDIGVISGPWPPYNFAS* | 168 |
| Stella vacuolata-ATCC-43931_gvpFL1 | MSGLLVFAIVPADGIEPGILAPREELPANLRAVAADGFAAVVGAAP EGGLKGRDRSVLLPRLLASQKVIERLMARGPVLPVTLGTVLEDEA RVRHMLAAGAPMLEAAFGTLGDCWQMDLSVRWDLNQVVARLM GEVPGDVRAAAGSGDEAARRALGEALAGLAAGERRRVQSRLAA ALRDVARDLIVSEPVEPESVVDIAILVERPALAEVEAALDRLDAEF EGRLKFRLVGPLAPHSFATVQVHLAPEAALAGACAELGVERGAGL QDVKVAYHRALVRFHPDLAPHGDDGGPEDEHDGGEGRASRLLTV TAAYRALQAEHAPISLRRQDGIAVNQEQDASAAMGQQRGIVPGRE LQALRM* | 169 |
| Stella vacuolata-ATCC-43931_gvpFL2 | MLYVYAIAADHPDPDNAMFGGEGIVPDAPVRLLQLGDLAVAASL VSAADFAADALRAHLEDARWTALRVLAHQRVVDSLLPHATVLP MKFCTLFSGEAALKQALAHNRAALQATVERLRGAREWGVKLYW EAPRNPAPPSAGQGEAGAGAAFFQRKRDQQRQRAEAEAAVARCV AASHRRLADAARAAVANPVQPPAVHRQPGEMALNGAYLVARAA EPAWREVLAELERTHADGGIRYELTGPWGPYNFTGSGLVGS* | 170 |
| Thiocapsa rosea strain DSM 235 Ga0242571-11_gvpFL | MSDRPRPMLHCILRSPPGSIARAEAGLRWIERDGLAALVADREPSE IAGASSVGLQRYADIVAEIHACAAVIPVRFGCLLAGDEAVGKLLHR SRDRLHGLLDQVGDCLEFGIRLLLPADAPAATDDDAAPRLHANAP | 171 |

TABLE 6-continued

Amino acid sequences of exemplary gvpA/B, gvpF, gvpF/L, gvpG, gvpJ, gvpK, gvpL, gvpN, gvpV, gvpW, gvpR, gvpS, gvpT, and gvpU proteins

| Species, protein; | Amino acid sequence | SEQ ID NO.: |
|---|---|---|
| | SDPRADPDMGPGLSHLLAIRHRLDVEASLAARAREAREVIKGRVA GRFREVREELGQIDGRSLLSLYFLVPREQGEHFVECLRQDASSLRG TGLLTGPWPPYNFVGAIDDDIRSLD* | |
| gvpG | | |
| Anabaena-flos-aquae_gvpG | MLTKLLLLPIMGPLNGVVWIAEQIQERTNTEFDAQENLHKQLLSL QLSFDIGEIGEEEFEIQEEEILLKIQALEEEARLELEAEQEEARLELEA EQEDFEYPPQFTAEVNKDQHLVLLP* | 172 |
| Bacillus-megaterium_gvpG | VLHKLVTAPINLVVKIGEKVQEEADKQLYDLPTIQQKLIQLQMMF ELGEIPEEAFQEKEDELLMRYEIAKRREIEQWEELTQKRNEES* | 173 |
| Ancylobacter aquaticus strain UV5_gvpG | MGMLTDVVFAPAVGPLKGVLWLARIIAEQAERTLYDEGVIRAALL DLEQQLEAGEIDEDAYETQETVLLERLKIARERMRSGL* | 174 |
| Aphanizomenon flos-aquae NIES-81_gvpG | MLTKLLLLPIMGPLNGLVWIGEQIQERTNTEFDAQENLHKQLLNL QLSFDIGEISEEDFEIQEEELLLKIQALEEEARLELELAEEEARLELEL EQEEEEDFVVKPQLTTEIDRDKDLVLLP* | 175 |
| Aphanothece halophytica (strain PCC 7418)_gvpG | MVFKLLLLPITGPIEGVTWLGEQILERANQELDEKENLNKRLLSLQ LSLDLGEISEEEYDEQEEEILLAMQAMEDEENNQAEEETD* | 176 |
| Aquabacter spiritensis strain DSM 9035_gvpG | MSLVTDVLFAPAVGPLKGVLWLARLIAEQAERTLYDEDVLRAAL LDLEQRFEAGEISEADYETEEDILLARLKIARERMRSGL* | 177 |
| Bradyrhizobium oligotrophicum S58_gvpG | MLFQILTSPVSGPFRMVSWIGGAIRDAVDTKMNDPAEIKRALAAL EQQLEAGSLSEQDYERMEMELIERLQSSLRHGSGNGG* | 178 |
| Burkholderia thailandensis sp. Bp5365 strain MSMB43_gvpG | MFILDNLLAAPIKGMFWIFEEIAQAAEEETIADIEMIKAALVELYRE LESGQIDETEFETRERALLDRLDSLETS* | 179 |
| Chlorobium luteolum DSM 273_gvpG | MFILDDILLAPLSGMVFLGRKINEIVQNEMSDEGAVKEQLMKLQF RFEMDELSEEEYDRLEDELLSTLAEIRAQKENR* | 180 |
| Dactylococcopsis salina PCC 8305_gvpG | MVFKLLLLPITGPIEGITWLGEQILERADQELDSKENLNKRLLSLQL SLDLGEISEEEYDEQEEEILLAMQAMEDEENEEEES* | 181 |
| Desulfobacterium vacuolatum_DSM 3385_gvpG | MFLVDDILFFPAKSLVWVFRELHNAVQQEKTNESDALTTELSELY MMLETGKITEEEFDEREEQILDRLDEIQERDQ* | 182 |
| Desulfomonile tiedjei DSM 6799_gvpG | MERYTMFLLDDILFLPMNGVLWICNEIHDAAEQELHNESDAITAQ LQKLYTLLEAGDIGESEFDVLEAELLDRLDAIQERGALLEA* | 183 |
| Desulfotomaculum acetoxidans_DSM 771_gvpG | MLGKLLLSPILGPVMGVKFIAEKIKQQADQELYDKSKIKQDLMEL QIKLELEEITEEYYLQREEELLVRLDELASMETEEEEV* | 184 |
| Dolichospermum circinale_gvpG | MLTQLLLLPIMGPLNGVVWIAEQIQERTNTEFDAQENLHKQLLSL QLSFDIGEISEEEFEIQEEEILLKIQALEEEARLELEAEQEEARLELEA EQEQARLELEAEQEELENQPQLTPKIDTYRHLVKL* | 185 |
| Enhydrobacter aerosaccus strain ATCC 27094_gvpG | MGMLARLLTLPVSAPVGGVLWIARKIEEEANAERWDRNKITGALS ELELELDLGAIDVEEYDAREAVLLQKLKELQEVEND* | 186 |
| Isosphaera pallida_ATCC-43644_gvpG | MFLVDDILLAPAHSLMFLLREIHQAALEELRRDAQKVREELAECY RALETGALTDEEFASLETDLLDRLDALEELARFNSDEDDDPEDED WDVEDDDPAEAVW* | 187 |
| Legionella drancourtii LLAP12_gvpG | MLLLGSILMAPVHGLMAIFEKIKEAVDEEKQHDIERIKSELMALYT KLESGELSEADFEKQEKILLDKLDSLEDEDD* | 188 |
| Microcystis aeruginosa NIES-843_gvpG | MFLDLLFLPVTGPIGGLIWIGEKIQERADIEYDEAENLHKLLLSLQL SYDMGNISEEEFEIQEEELLLKIQALEEEEAENESESSL* | 189 |

TABLE 6-continued

Amino acid sequences of exemplary gvpA/B, gvpF, gvpF/L, gvpG, gvpJ,
gvpK, gvpL, gvpN, gvpV, gvpW, gvpR, gvpS, gvpT, and gvpU proteins

| Species, protein; | Amino acid sequence | SEQ ID NO.: |
|---|---|---|
| Nostoc punctiforme ATCC 29133_gvpG | MVLRFLLLPITGPLMGVTWLGEKILEQASTEIDDKENLSKQLLALQ LAFDMGEIPEEEFEIQEEALLLAILEAEQEERDQTQEY* | 190 |
| Nostoc sp. PCC 7120_gvpG | MLGKILLLPVMGPINGLMWIGEQIQERTNTEFDAQENLHKQLLSL QLKFDMGEISEEEFDIQEEEILLKIQALEAEERLNAESEEDDDLDVQ PIFILASEENPVYQDQSRFSEEYEDKEDLVLSP* | 191 |
| Octadecabacter antarcticus 307_gvpG | MGIILNTLMSPLIGPMKGVFWVAEQIKDQTDAEIYDDSKILVELSE LELLLDLEKIELKDFEAKEDVLLKRLQEIRKAKKNDSV* | 192 |
| Octadecabacter arcticus 238_gvpG | MSIILNTLMGPLIGPMKGLLWVAEQIKDQADAELYDDSKILVALSE LELSFDLEQIELKEFEAQEDVLLQRLQAIRKAKQNDTD* | 193 |
| Pelodictyon phaeoclathratiforme_ gvpG | MFILDDILFAPLNGLIFIAKKINDVVEKETSDEGVVKERLMALQLRF ELDEIDEVEYDREEDELLQKLERIRLNKQNQ* | 194 |
| Phormidium tenue NIES-30_gvpG | MLFKLLFAPVLGPIEGISWVANKLLEQADVPTNDLESLQKQLLAL QLAFDMGEVAEADFEIQEEEILLAIQAIEDEEDEDE* | 195 |
| Planktothrix agardhii str. 7805_gvpG | MILRLLLSPITAPFEGVIWIGEQLLERAEAELDDKENLGKRLLALQL AFDMGDIPEEDFEVQEEELLLQIQALEDEANQENDEID* | 196 |
| Psychromonas ingrahamii 37_gvpG | MFILDDILLAPYSGIKWLFKEIQRQAQEELDGEADRITTDLTNLYR QFESNEITEQEFEERETVLLDRLDELQEESNLLDEEYDEEYEDDDE EYEDDDEEYEDDDEEYEDDDEEYEDDDKNDKDKNDDHDNDDDD ENKDENDKYNDEER* | 197 |
| Rhodobacter capsulatus SB 1003_gvpG | MGLLRKLLLAPVELPITGALWIVEKIAETAESELTDPGTVRRLLRG LEQQLEAGEITEEEYEFAEEILLDRLKRGQAAEARSGGP* | 198 |
| Rhodobacter sphaeroides 2.4.1_gvpG | MGLLTSLLTLPFRGPFDGTLWIAARIGEAAEQSWNDPAALRAALV EAERQLLAGELSEETYDAIELDLLERLKGTAR* | 199 |
| Rhodococcus hoagii 103S_gvpG | MGLFSAIFGLPLAPVRGVVWIGEVVRRQVEEETTSPAAMRRDLEAI EEGRRSGEISEDEAAQAEDEILHRVTRRRDAGASGEE* | 200 |
| Serratia sp. ATCC 39006_gvpG | MLLIDDILFSPVKGVMWIFRQIHELAEDELAGEADRIRESLTDLYM LLETGQITEDEFEQQEAVLLDRLDALDEEDDMLGDEPGDDEDDEY EEDDDEEDDDEEDDDDEDDDDEDDDDEEDDDDEDDDDEDEPE GTTK* | 201 |
| Stella vacuolata_ATCC-43931_gvpG | MGLVTNVAFAPVVGPLKGVLWLARLIADQAERTLYDEDLVRAAL LDLEQRLDAGQISEADYDAEEEILLARLKIARERMRSGL* | 202 |
| Thiocapsa rosea strain DSM 235 Ga0242571_11_gvpG | MLIVDDLLAAPFKGIIWVFEEIHKSATAEQRARRDEIMAALSALYR ALEQGEITDDTFDTREQALLDELDALDAREDANELGSDEDEDDLD GAGEDAS* | 203 |
| Tolypothrix sp. PCC 7601_gvpG | MEVMIMLGKILLFPVMGPISGLMWIGEQIQERTDTEFDAQENLHK QLLSLQLSFDIGEISEEDFEEQEEELLLKIQALEEEKARLEAESIEDE EDEVEPTYFIAEVEEDKVLAEAFRGNKKYEDNENLVLSP* | 204 |
| Trichodesmium erythraeum IMS101_gvpG | MLLRLLTLPISGPLEGVTWLGKKLQEQVDTEIDETENLSKKLLTLQ LAFDMGEISEEDFEDQEEELLLAIQALEEQKLKEEEEDA* | 205 |
| gvpJ | | |
| Anabaena-flos-aquae_gvpJ | MLPTRPQTNSSRTINTSTQGSTLADILERVLDKGIVIAGDISISIASTE LVHIRIRLLISSVDKAKEMGINWWESDPYLSTKAQRLVEENQQLQ HRLESLEAKLNSLTSSSVKEEIPLAADVKDDLYQTSAKIPSPVDTPI EVLDFQAQSSGGTPPYVNTSMEILDFQAQTSAESSSPVGSTVEILDF QAQTSEESSSPVVSTVEILDFQAQTSEESSSPVGSTVEILDFQAQTSE EIPSSVDPAIDV* | 206 |
| Bacillus-megaterium_gvpJ | MAVEHNMQSSTIVDVLEKILDKGVVIAGDITVGIADVELLTIKIRLI VASVDKAKEIGMDWWENDPYLSSKGANNKALEEENKMLHERLK TLEEKIETKR* | 207 |

TABLE 6-continued

Amino acid sequences of exemplary gvpA/B, gvpF, gvpF/L, gvpG, gvpJ, gvpK, gvpL, gvpN, gvpV, gvpW, gvpR, gvpS, gvpT, and gvpU proteins

| Species, protein; | Amino acid sequence | SEQ ID NO.: |
|---|---|---|
| Ancylobacter aquaticus strain UV5_gvpJ1 | MNEQRMEHSLQAVGLADILERVLDKGIVIAGDITISLVEVELLNIRL RLVVASVDRAMSMGINWWQSDPHLNSHARELAEEENKLLRERLDR LEAAVVPSALPADAALEPSLAGEDARHGG* | 208 |
| Ancylobacter aquaticus strain UV5_gvpJ2 | MPSRHSGEIAVADLLDRALHKGLVVWGEATISVAGVDLVYLGLK LLLTSTDTVNRMREAANAPPDERHLHAD* | 209 |
| Aphanizomenon flos-aquae NIES-81_gvpJ | VTSTPILPTRPQTNSSRAINTSTQGSTLADILERVLDKGIVIAGDISISI ASTELIHIRIRLLIASVDKAKEMGINWWETDPYLSTKAQRLVEENQ QLQNRLENLESQINLLTSAKVQEQISLVETTEDNTHQTTEDNTHQT HEESIPLPIDSQLDV* | 210 |
| Aphanothece halophytica (strain PCC 74418)_gvpJ | MVNPNTNKPKSYQSKGITNSTQSSSLADILERVLDKGIVIAGDITVS VGSTELLSIRIRLLVSSVDKARELGINWWEGDPYLSSQANLLKEEN QALQNRLENMEAELRRLKGETNPEPSFLSESEDNS* | 211 |
| Aquabacter spiritensis strain DSM 9035_gvpJ1 | MSEQRMEHSLQAVGLADILERVLDKGIVIAGDISISLVEVDLLNIRL RLVVASVDRAMSMGINWWQSDPHLNSHARQLEEENRLLRERLDR LEAALAPPEGGMLRAEVEVAHGG* | 212 |
| Aquabacter spiritensis strain DSM 9035_gvpJ2 | MPDPEPIIPRTSGDVALADLLDRALHKGLVLWGEATISVAGVDLV YLGLKVLLASTDTANRMRDAAAASAAGSHLPGG* | 213 |
| Arthrospira platensis NIES-39_gvpJ | MTLQSRSSSPQRGVPMSTSGSSLADILERVLDKGIVIAGDISVSVGS TELLSIRIRLLIASVDKAKEIGINWWESDPYLSSQAQQLSQSNQQLL EEVKRLQEEVRSLKALTSQSSQPVTPPNSENDD* | 214 |
| Bradyrhizobium oligotrophicum S58_gvpJ1 | MTFTVHQPTGGDRLADILERVLDKGIVVAGDVTISLVGIELLNIKIR LIVATVDRALELGINWWEADPRLTTRASELSVENEELKKRLALLE ADAGRNQRPRKRRVRSIAATSGASHER* | 215 |
| Bradyrhizobium oligotrophicum S58_gvpJ2 | MTYRADLDYLEPAASSEGSLLELLDHLLDRGVLLWGELRISVADV ELIEVGLKLMLASARTADRWRQTTTQRASIAPGDCP* | 216 |
| Burkholderia thailandensis sp. Bp5365 strain MSMB43_gvpJ1 | MRSADGEPVSAELAQRLSLCESLDRILNKGAVISAQVVVSVADVD LLYLHLRLLLTSVETALVGRAMPREEASR* | 217 |
| Burkholderia thailandensis sp. Bp5365 strain MSMB43_gvpJ2 | MADLLERVLDKGVVITGDIRINLVDVELLTIRIRLLVCSVDKAKEL GIDWWNADTFFLGPDRGQSALPGRASAVDVAAGSAVHADAAHR* | 218 |
| Chlorobium luteolum DSM 273_gvpJ1 | MPELKHAVNATGLADILERVLDKGIVIAGDIKIQIADIDLLTIKIRL MVASVDKAIEMGINWWQEDPYLSTGAKTSEQTRLLGEINQRIEKL ESINR* | 219 |
| Chlorobium luteolum DSM 273_gvpJ2 | MQEDLYTANRQVTLLDILDRVLNKGVVISGDIIISVAGIDLVYVGL RVLLSSVETMERLDAARAEGLQQ* | 220 |
| Chlorobium luteolum DSM 273_gvpJ3 | MAVEKTIGSSSLVEVIDRILDKGVVVDAWVRVSLVGIELLAIEARV VVASVETYLKYAEAIGLTAKAA* | 221 |
| Chlorobium luteolum DSM 273_gvpJ4 | MAVEKTIGSSSLVEVIDRILDKGVVVDAWVRVSLVGIELLAIEARV VVASVETYLKYAEAIGLTAKAA* | 222 |
| Dactylococcopsis salina PCC 8305_gvpJ | MVNSNTNQPKSYQSKGITNSTQSSSLADILERVLDKGIVIAGDISVS VGSTELLTIRIRLLISSVDRAREIGINWWESDPYLSSQAHLMKEENQ ALQSRLENMEAELRRLKGETNLDQSSLGESDQRSLQ* | 223 |
| Desulfobacterium vacuolatum_DSM 3385_gvpJ1 | MAYIDIDNDASKQISICEALDRVLNKGAVITGELTISVADIDLIYLSL QAVLTSVETARHMFDSQINDAVKEVK* | 224 |
| Desulfobacterium vacuolatum_DSM 3385_gvpJ2 | MPIQRTAQHSIESTNIADLLERVLDKGIVIAGDIKISLVDIELLSIQLR LVICSVDKAKEMGMDWWVNNPVFMPNKGTQNDEIADTLTKINSR LEHLEKATISGS* | 225 |

TABLE 6-continued

Amino acid sequences of exemplary gvpA/B, gvpF, gvpF/L, gvpG, gvpJ, gvpK, gvpL, gvpN, gvpV, gvpW, gvpR, gvpS, gvpT, and gvpU proteins

| Species, protein; | Amino acid sequence | SEQ ID NO.: |
|---|---|---|
| Desulfomonile tiedjei DSM 6799_gvpJ1 | MMDEEEHVSLCEALDRVLNKGAVIAGEVTISVANVDLIYLGLQVV LASVDTIRGKRNELLRHDVGLHLTADNA* | 226 |
| Desulfomonile tiedjei DSM 6799_gvpJ2 | MSIQASTRHSIQSTNLADLLERVLDKGVVIAGDIKIKLVDVELLTIQ IRLVVCSVDKAKEMGMDWWTNNPAFQPALAQISE* | 227 |
| Desulfotomaculum acetoxidans_DSM 771_gvpJ1 | MGPQMGPIKSTGNLSLLDVIDRILDKGLVINADISVSIVGVELLGIKI KAAVASFETAAKYGLQFPTGTEINEKVSEAAKQLKEICPECGKKSG RDELLHEGCPWCGWISARALRLETEHSQR* | 228 |
| Desulfotomaculum acetoxidans_DSM 771_gvpJ2 | MLPIREERATLTDLLDRVLDKGLLLNADILISVAGVPLIGITLKAAI AGMETMKKYGLLIDWDQESRLAERRLRSSRH* | 229 |
| Enhydrobacter aerosaccus strain ATCC 27094_gvpJ1 | MAVTNGRMEHSIQGSSLADILDRILDKGIVIAGDVTISLVGVELLNI RLRLLVASVDKAIEMGINWWEADPYLTSQTKASSEQTELLQQRLE RIEGLLAGQATKEQPL* | 230 |
| Enhydrobacter aerosaccus strain ATCC 27094_gvpJ2 | MPVQTAHDGELALADLLDRALNKGVVLWGDATISLAGVELVYV GLRVLVASCSTMEKYRSSPRKGSMPIARGES* | 231 |
| Isosphaera pallida_ATCC- 43644_gvpJ1 | MIVCSSSTPERIGPPMNLPPPHHAPWCYDSPDLETLPLDPAERIALC EVLDRVLNKGVVIHGEITISVAGVDLVYLGLNLLLTSVETAQSWK FRGMIE* | 232 |
| Isosphaera pallida_ATCC- 43644_gvpJ2 | MAITRSSRPDVTHSTSGATLADVLERVLDKGLVIAGDIKIKLVDVE LLTIQIRLVVASVDKAREMGLDWWTRSPELSSLAATTCPALTPPKQ EATPPATRIQAPTESAQTTPDQSHPSDPSASNIDEVAELRRHIELMQ LRDEARQRAHREELAALRAQLTRLTELLDSPR* | 233 |
| Legionella drancourtii LLAP12_gvpJ1 | MIIEDKPVSLCETLDRVLNKGVVVAGTVTISVADVDLLYLDLHCL LSSMKGMNLIGSERER* | 234 |
| Legionella drancourtii LLAP12_gvpJ2 | MELQKSPTHSIGSTTIADLLERILDKGIVIAGDIKVNLVQVELLTIQI RLLICSVDKAKEIGMDWWTHQNDVQSKNGSMPIQEYVTQMEERL KNLENTLASSKNAI* | 235 |
| Lyngbya confervoides BDU14195 1_gvpJ | MTGQSLSRSSSANRQMATATQGSTLVDVLERVLDKGIVIAGDISVS VGSTELLTIRIRLLVASVDKAREMGINWWENDPYLSARSQELLTA NEQLQSRIESLEQELKSLRSQED* | 236 |
| Microcystis aeruginosa NIES-843_gvpJ | MTSSTFAGSLRNQSNNSLKTATQGSSLADILERVLDKGIVIAGDISV SIASTELINIRIRLLIASVDKAREMGINWWEGDPYLHSQSQALLAEN RELSLRLQTLETELETLKSLTQLSAMESHDTSPNDEAHSSDA* | 237 |
| Nostoc punctiforme ATCC 29133_gvpJ | MSTNTNRGAITTSTQGSTLADILERVLDKGIVIAGDISISVGSTELLN IRIRLLISSVDKAKEIGINWWESDPYLNSQTRTLLATNQQLQERLAS LETELQSLKALNPINHQNAGD* | 238 |
| Nostoc sp. PCC 7120_gvpJ | MTTTPIHPTRPQTNSNRVIPTSTQGSTLADILERVLDKGIVIAGDISIS IASTELIHIRIRLLISSVDKAREMGINWWENDPYLSSKSQRLVEENQ QLQQRLESLETQLRLLTSAAKEETTLTANNPEDLQPMYEVNSQEG DNSQLEA* | 239 |
| Octadecabacter antarcticus 307_gvpJ1 | MNDGKMEHSLNATNLADILERVLDKGIVIAGDVTISLVGVELLNIK LRLLIASVDKAMEMGINWWAHDPFLTAGAQAPAVADPAMLERM DRLEAALATALASNQTTPMKGHK* | 240 |
| Octadecabacter antarcticus 307_gvpJ2 | MTNKAQGGQDLALADLLDRALSTGVVIWGEATISLAGVDLVYVG LKVLVASVDAAERMKAASLVDRPTDRGQQI* | 241 |
| Octadecabacter arcticus 238_gvpJ1 | MNNGKMEHSLDATNLADILERVLDKGIVIAGDVTISLVGVELLNIK LRLLIASVDKAMEMGINWPYLTAGAQAPVGVDPAMLERM DRLEAALAKALASNQTTPAEGQSS* | 242 |
| Octadecabacter arcticus 238_gvpJ2 | MTNETQGGQDLALADLLDRALSTGVVIWGEATISLAGVDLVYVG LKVLVASVDAAQRMKDASLVDRPTDGGQ* | 243 |
| Pelodictyon phaeoclathratiforme_ gvpJ1 | MPELKHAVNATGLADILERVLDKGIVIAGDIKIQIADIDLLTIKIRLL IASVDKAMEMGINWWQEDTYLSTKAKDKEQQLLRDDLQQRIEKL EALTKIT* | 244 |

TABLE 6-continued

Amino acid sequences of exemplary gvpA/B, gvpF, gvpF/L, gvpG, gvpJ, gvpK, gvpL, gvpN, gvpV, gvpW, gvpR, gvpS, gvpT, and gvpU proteins

| Species, protein; | Amino acid sequence | SEQ ID NO.: |
|---|---|---|
| Pelodictyon phaeoclathratiforme_ gvpJ2 | MQDEFYSKNKEITILDVLDRVLTKGVVITGDIVISVADIDLVYVGL RLLLSSVETMEKNKQNSIKM* | 245 |
| Phormidium tenue NIES-30_gvpJ | MATATQGSSLVDVIERVLDKGIVIAGDISVSVGSTELLSIRIRLIISSV DKAREIGINWWESDPYLSSRTNELLEANQQLQSRLETLEAELKALR SAEPVS* | 246 |
| Planktothrix agardhii str. 7805_gvpJ | MNSQQLPSNIQRGVPTSTQGSSLADILERVLDKGIVIAGDISVSVGS TELLNIRIRLLIASVDKAREIGINWWESDPYLSSQTKVLTESNQQLL EQVKFLQEEVKALKALLPQENQPNPISDPHK* | 247 |
| Planktothrix rubescens_gvpJ | MNSQQRPSNIQRGVPTSTQGSSLADILERVLDKGIVIAGDISVSVGS TELLNIRIRLLIASVDKAREIGINWWESDPYLSSQTKVLTESNQELL EQVKLLQEEVKALKALLPQENQPKEME* | 248 |
| Psychromonas ingrahamii 37_gvpJ1 | MANVQKSTDSSGLAEVVDRILEKGIVIDAFVKVSLVGIELLSIEARV VIASVETYLKYAEAIGLTASAATPA* | 249 |
| Psychromonas ingrahamii 37_gvpJ2 | MPMANVSINPELTAQECEKISLCDALDRIINKGVVIHGEITISVANV DLISLGVRLILSNVETREQSNTPKEEV* | 250 |
| Psychromonas ingrahamii 37_gvpJ3 | MATGKPQSMTHSVKSTTVADLLERILDKGIVVTGDIKIKLVDVELL TVELRLVICSVDKAVEMGMDWWNNNPAFAPQAPAQEGELSSIEK RLEKIEKALVK* | 251 |
| Rhodobacter capsulatus SB 1003_gvpJ1 | MGYRSASQPEGLADVLERILDKGIVIAGDVSVSLVGIELLTIRLRLL IATVDKAREMGIDWWSHDPYLNGRLRPGEPAPETETETAALRDRL AQLEAQLSALGAQVGAAPALAEPALRGLAAAGSSALCAAPEASSA DVVQPVFRRYKEAP* | 252 |
| Rhodobacter capsulatus SB 1003_gvpJ2 | MDDRFSLRLFGPEEVFDAPSGGLADLLDGLLGHGIVLHGDLWLTV ADVELVYVGLSAVLASPEALRSHE* | 253 |
| Rhodobacter sphaeroides 2.4.1_gvpJ1 | MSFQMQSPLQQDSLADVLERILDKGIVIAGDISISLVGIELLTIRLRL LVATVDKAREMGINWWESDPRLCITQAPASDGSAALLDRLERIET QIGQLAAAREG* | 254 |
| Rhodobacter sphaeroides 2.4.1_gvpJ2 | MTDSAPTLQFATAEEALQSSETRLVDVVDALLSQGIAIRGELWLTI ADVDLVFLGLDLLLANPDRLQCRVPDAA* | 255 |
| Rhodococcus hoagii 103S_gvpJ | MTRSGSGANYPQQYSQGLGGAGHEPANLGDILERVLDKGIVIAGD IRVNLLDIELLTIKLRLVIASLETAREVGIDWWEHDPWLSGNNRDL ELENERLRARIEALESGERRVADVTDPHRAVQPAESPAAEVRDDD A* | 256 |
| Serratia sp. ATCC 39006_gvpJ1 | MPVNKQYQDEQQQVSLCEALDRVLNKGVVIVADITISVANIDLIYL SLQALVSSVEAKNRLPGRE* | 257 |
| Serratia sp. ATCC 39006_gvpJ2 | MSGNKKLTHSTDSTTVADLLERLLDKGVVISGDIRIRLVEVELLTL EIRLLICSVDKAVEMGLDWWSGNPAFDSRARVSSSAPAPELEERL QRLEARLEAAPSVIEETHL | 258 |
| Stella vacuolata_ATCC-43931_gvpJ1 | MSGQRMEHSVQAVGLADILERVLDKGIVIAGDISISLVEVELLTIRL RLVVASVDRAMSMGINWWQSDPNLNSHARQLEEDNRLLRERLDR LEAALALPEMAGERLADAGQGGGAEQGVTHGR* | 259 |
| Stella vacuolata_ATCC-43931_gvpJ2 | MSDPEPIIPRTSGDIALADLLDRALHKGLVLWGEATISVAGVDLVY LGLKVLVASTETADRMRAAAASQSADPKVRAG* | 260 |
| Thiocapsa rosea strain DSM 235 Ga0242571_11_gvpJ1 | MMLAIGEHPDCPEEIQRVSLCEALDRILNKGAVVSGELTIAVANVD LLYLSLQLVITSVETAKREMLYVRH* | 261 |
| Thiocapsa rosea strain DSM 235 Ga0242571_1 l_gvpJ2 | MSVQRSTLTHSTNSTSVADLLERVLDKGIVIAGDIRIKLVDIELLTIQ LRLVICSVDKAREMGIDWWSDNAMFKGLSSQASAASLPGTAAAS GIEDRLARLESLLVKQSAAAETVL* | 262 |

TABLE 6-continued

Amino acid sequences of exemplary gvpA/B, gvpF, gvpF/L, gvpG, gvpJ, gvpK, gvpL, gvpN, gvpV, gvpW, gvpR, gvpS, gvpT, and gvpU proteins

| Species, protein; | Amino acid sequence | SEQ ID NO.: |
|---|---|---|
| Tolypothrix sp. PCC 7601_gvpJ | MADILERVLDKGIVIAGDISVSIASTELLHIRIRLLISSVDKAKELGIN WWENDPYLSSKSQRLVEENQQLQQRLESLEAQLRSLTAAKINNPE LFPVNAEDNGQSDEENVPLPMNYQPND* | 263 |
| Trichodesmium erythraeum IMS101_gvpJ1 | MFIRVDFLLDKGVIVDAWVRLSLVVIELLTIEAKIVIASVEAYLKYS EAFCFNY* | 264 |
| Trichodesmium erythraeum IMS101_gvpJ2 | MAVEKVNSSSSLAEVIDRILDKGVVVDAWIRLSLVGIELLTIEARIV VAVETYLKYAEAVGLTTLAAAPGEAAA* | 265 |
| Trichodesmium erythraeum IMS101_gvpJ3 | MAVEKVNSSSLAEVIDRILDKGVVVDAWVRLSLVGIELLTIEARI VIASVETYLKYAEAVGLTTLAAEPAA* | 266 |
| Trichodesmium erythraeum IMS101_gvpJ4 | MKTSANIATSASGNGLADVLERVLDKGVVIAGDISVSIASTELLNI KIRLLISSVERAKEIGINWWESDPYFSSQNNSLVQANEKLLERVASL ESEIKALRSN* | 267 |
| Trichodesmium erythraeum IMS101_gvpJ5 | MKTSANIAKSAGGDSLADVLERVLDKGIVIAGDISVSIASTELLNIK IRLLISSVERAKEIGINWWESDPSLSSQNNSLVQVNQKLLERVASLE SEIEALKYSQ* | 268 |
| gvpK | | |
| Anabaena-flos-aquae_gvpK | MVCTPAENFNNSLTIASKPKNEAGLAPLLLTVLELVRQLMEAQVIR RMEEDLLSEPDLERAADSLQKLEEQILHLCEMFEVDPADLNINLGE IGTLLPSSGSYYPGQPSSRPSVLELLDRLLNTGIVVDGEIDLGIAQID LIHAKLRLVLTSKPI* | 269 |
| Bacillus-megaterium_gvpK | MQPVSQANGRIHLDPDQAEQGLAQLVMTVIELLRQIVERHAMRR VEGGTLTDEQIENLGIALMNLEEKMDELKEVFGLDAEDLNIDLGPL GSLL* | 270 |
| Ancylobacter aquaticus strain UV5_gvpK | MTAPCTAETLENALRGRIDIDPEKVEQGLVKLVLMLVETVRQVVE RQAIRRVEGGTLTEEETERLGLALMRLEEKMAELRLHFGLEDGDL DLKLQLPLGEL* | 271 |
| Aphanizomenon flos-aquae NIES-81_gvpK | MVYSPVENSNDFLNVIPVENSNEFLNTSPKKKSNSETGLAPLLLTV LELIRQLMEAQIIRRMEEDLLSESDLERTAESLQKLEEQILNLCQIFD IDPADLNINLGDFGSLLPASGSYYPGETGNRPSILELLDRLLNTGIV VDGEIDIGVAQLDLIHAKLRLVLTSKPI* | 272 |
| Aphanothece halophytica (strain PCC 7418)_gvpK | MSADESNLSQVNLNPATSNSDAGLAPLLLTVTELIRQLMEAQVIRR MDGGLLNEEELDRAGDSLQRLEAEIIRLCEIFEIDPKDLNVDLGELG TLMPKNGGYYPGESSDDPSILELLDRILHKGVVIDGNLDLGIAQLS LIQARLHLVLTSQPINGK* | 273 |
| Aquabacter spiritensis strain DSM 9035_gvpK | MTGFAGGPAVTETLESVLQGRVDIDPERVEQGLVKLVLMVVETLR QVIERQAIRRVEAGALTDEEIERLGLTLLRLEEKMAELRVQFNLSE ADLSLKLRLPLGEL* | 274 |
| Bradyrhizobium oligotrophicum S58_gvpK | MSASSHSEAPGLRLQLGDLDTALAAVFTDAAPNGSINLDPDKIEHD LARLVLTLIEFLRRLLELQAIRRMEANELSEDEEERVGLALMRAAA QVSRLARELGVDPRELNLQLGPLGRLL* | 275 |
| Burkholderia thailandensis sp. Bp5365 strain MSMB43_gvpK | MNAPHAAAVSDAAALAAALEQALAQQQAPPPRATQRFDVATAS AGNGLAKLVLALMKLLHELLERQALRRIEAGSLNDDEIERLGLAL MRQAEEIERLAAQFGFTDADLNLDLGPLGRLF* | 276 |
| Chlorobium luteolum DSM 273_gvpK | MHEDKVQFQASSVEEALRQLEGMKQGKESRIEANPDNVESGLAR LVLTLIELLRKLMEKQAMRRIDGGSLDEAQIDELGETLMKLEMKM DELKKTFNLTDSDLNLNLGPLGDLM* | 277 |
| Dactylococcopsis salina PCC 8305_gvpK | MSEEESNLSRVDLNPASSNSDAGLAPLLLTVTELIRQLMEAQVIRR MDAELLTEAELDRAGESLQRLEEEILRLCEIFDVDPADLNVHLGEL GTLLPKEGGYYPGETSDQPSILELLDRVLHTGVVIDGNLDLGIAQL NLIQAKLHLVLTSQPINN* | 278 |

TABLE 6-continued

Amino acid sequences of exemplary gvpA/B, gvpF, gvpF/L, gvpG, gvpJ, gvpK, gvpL, gvpN, gvpV, gvpW, gvpR, gvpS, gvpT, and gvpU proteins

| Species, protein; | Amino acid sequence | SEQ ID NO.: |
|---|---|---|
| Desulfobacterium vacuolatum_DSM 3385_gvpK | MIKDPEAKDFKIESDSIDAFARVMHADTSSCSSSSVTAGQRQQRLK IDEENIKNGLAQLVMTLIKLLHELLERQAIRRIESGSLDDDQIERLG LTLMQQCEEIDRLRKLFDLEEEDLNLDLGPLGKLL* | 279 |
| Desulfomonile tiedjei DSM 6799_gvpK | MNPMNIAKVESDSLGDFAEIMQTDWISSLHSDKEEKRLNLNQDSV KNGLGQLVLTLVKLLHDLLERQAIRRMEAGTLTDTEIDRLGTTLM MQAQEIERLRSEFGLEEEDLNLDLGPLGKLL* | 280 |
| Desulfotomaculum acetoxidans_DSM 771_gvpK | MYIDISEGSLKQGVLGLLLALVEIIKDALKIQALKRIEGDSLTEDEIE RLGNALHELEEALVEIEMEHNLQNVVQNIREGLDNVVNEVVDTFN PERWIAENEFN* | 281 |
| Dolichospermum circinale_gvpK | MLSTPADNFDESLTTVSKSKNEAGLAPLLLTVLELLRQLMEAQVIR RMEDNLLSESELERAADSIQKLEEQILHLCETFEVDPAELNINLGDF GTLLPQSGSYYPGETGSRPSVLELLDRLLNTGVVLDGEIDLGLAQL DLIHAKLRLVLTSKPI* | 282 |
| Enhydrobacter aerosaccus strain ATCC 27094_gvpK | MTKLLEAKTVDPDKAGDDLVKLVLALVETLRQLVERQAIRRVDS GVLNDDEVERLGLALLRLEEKMSELKAHFGFGDEELTLKLGSLGE LARDV* | 283 |
| Isosphaera pallida_ATCC-43644_gvpK | MSDSLFEVRSPSAAPPSPVNPGVADEWTAVLKDWDTLTAQLRQA TAPPNAENSARSHATTGRIDLDPEQVGDGLAKLVLTLLELIRQLLE RQAIRRLDAGSLDHEQTERLGLTLMRLAQRMEELKTHFGLQGEDL NLDLGPLGKLL* | 284 |
| Legionella drancourtii LLAP12_gvpK | MNDKREEDNALPQRINLQPDDVKNGLGKLVLILIQLIHELLERQAI GRIEAGDLSDEQIDRLGITLMKQAEEIDKLREVFGLTQEDLNLDLG PLGKLL* | 285 |
| Microcystis aeruginosa NIES-843_gvpK | MTLACTPYDSDNQALLTRPESNSQAGLAPLLLLTVVELVRQLLEAQI IRRMEKGVLSESDLDRAAESIQKLQEQILYLCEIFEVEPEELNVHLG EFGTLLPEAGSYYPGEEGIKPSVLELVDRLLNTGVVEGNVDLGL AQLDLIHLKLRLVLTSQPV* | 286 |
| Nostoc punctiforme ATCC 29133_gvpK | MQAISKSKGSDSGLAPLLLTVVELIRQLMEAQVIRRMDAGTLNDS ELDRAAESLQKLEQQVVQLCEIFDIDPADLNINLGEMGNLLPQSGG YYPGETSSQPSILELLDRLLNTGVVEGDLDLGLAQLSLVHAKLRL VLTSKPL* | 287 |
| Nostoc sp. PCC 7120_gvpK | MVCTPVEKSPNLLPTTSKANSKAGLAPLLLLTVVELIRQLMEAQVIR RMEQDCLSESELEQASESLQKLEEQVLNLCHIFEIEPADLNINLGDV GTLLPSPGSYYPGEIGNKPSVLELLDRLLNTGIVVDGEIDLGLAQLN LIHAKLRLVLTSRPL* | 288 |
| Octadecabacter antarcticus 307_gvpK | MKTTSDSQFDSMKKILTDSSKEDSASCDPTDLLPNKSLPPSLSTSPE TAADDLVKLVLAVIDTVRQVMEKQAIRRVESGALAEAEIERLGLT LMRLEARMVELKSHFGLSNEDLNLHFGTVQDLKDILNDEE* | 289 |
| Octadecabacter arcticus 238_gvpK | MKTQNDTQFDSMKKILTDSGGGDPNPNGSPDQTQHASLPSNLSTD PETAADDLVKLVLAVIDTVRQVMERQAIRRVDSGALADEEIERLG LTLMRLEERMADLKSHFGLSNEDLNLNFGTVQDLKDILNDEE* | 290 |
| Pelodictyon phaeoclathratiforme_ gvpK | MDSDKILYYAGSADEIIEELEKLKPGIQGRINATPDNVESGLAKLVL TLIELIRKLIEKQAMRRIDGNSLSESQIEELGETLMKLEKKMEELKG IFNLTDKDLNLNLGPLGDLM* | 291 |
| Phormidium tenue NIES-30_gvpK | MTSENAEPDLSTTLALQPPAKTDAGLAPLLLTVIELVRQLMEAQVI RRMESGDLDDNDLERAADSLRKLEEQVVSMCEIFDVDPADLNIDL GEIGTLLPKEGNYYPGQKNQNPTILELLDRLLDTGVVVEGDVDLG MAQLNLIHAKLRLVLTSKPI* | 292 |
| Planktothrix agardhii str. 7805_gvpK | MSSSEPSIETIITPKSSRKDAGLAPLVLTLVELIRQLMEAQVIRRMEG NTLSEEELDRAAQSLQQLEIQVLKLCEIFEIDPTDLNIELSEFGTLLP KSGSYYPGENTQNPSILELLDRLMNTGIVVEGSVDLGLAQLNLIHA KLRLVLTSKPL* | 293 |
| Psychromonas ingrahamii 37_gvpK | MPFEHFKSNNQADVNSDTKPAASVGGLNLESDDLKNGLGRLVLT LVKLLHELLERQALRRMDAGSLQDDEIERLGLAFMKQAEEIDRLR KEFGLEVEDLNLDLGPLGRLL* | 294 |

TABLE 6-continued

Amino acid sequences of exemplary gvpA/B, gvpF, gvpF/L, gvpG, gvpJ, gvpK, gvpL, gvpN, gvpV, gvpW, gvpR, gvpS, gvpT, and gvpU proteins

| Species, protein; | Amino acid sequence | SEQ ID NO.: |
|---|---|---|
| Rhodobacter capsulatus SB 1003_gvpK | MSAAMHLELGDVDAVLSQAARSLAAGGRLTLDPERVEQDLARLV LGIVELLRKLMELQAIRRMEAGSLTPEQEETLGLTLMRAEAALHE VAAKFGLQPADLILDLGPLGRSV* | 295 |
| Rhodobacter sphaeroides 2.4.1_gvpK | MTYPFPPLLLRDDRLPPTEAPVTAPRIALDPDRLEHDLARILLGLME MLRQIMELQAIRRMEAGSLSESQQEQLGTTLMRAEAAIHEMAARF GLTPADLSLDLGPLGRTI* | 296 |
| Rhodococcus hoagii 103S_gvpK | MRRRIDSDPESVERGLVALVLTLVELLRQLMERQALRRVDAGDLS DDQIERIGTTLMLLEEKMEELREHFGLEPEDLNIDLGPLGPLLAED* | 297 |
| Serratia sp. ATCC 39006_gvpK | MTTNQLSHHSPVFGPTSPAIQRPITEANRHKIDIDGERVRDGLAQL VLTLVKLLHELLERQAIRRMDSGSLSDEEVERLGLALMRQAEELT HLCDVFGFKDDDLNLDLGPLGRLL* | 298 |
| Stella vacuolata_ATCC-43931_gvpK | MTGFLNGPADVETLETALRGRVDIDPERVEQGLVKLVLMVVETLR QVIERQAIRRVESGSLTDDEVERLGLTLMRLEEKMDQLRRQFDLG EEDLSMRLRLPLQEL* | 299 |
| Thiocapsa rosea strain DSM 235 Ga0242571_11_gvpK | MSDTRTGTAPSSAASAAPDTSTLQRANLLADLLETKVAAAGRRIDI DPERVQRGLGQLVLTVVKLLHVLLERQAIRRVDGGDLDEDEIEQL GLALMRQSEEIERLRRLLGLEEQDLNLDLGPLGKLF* | 300 |
| Tolypothrix sp. PCC 7601_gvpK | MAMVCTPSENSNDLLATNSKANNQAGLVPLLLTVVELIRQLMEA QVIRRMEEECLSESDLERAAESLQKLEEQVLNLCQIFEIDPADLNIH LGELGSLLPAAGSYYPGETGNTPSVLELLDRLLNTGVVVDGELDL GVAQLNLIHAKLRLVLTSKPLNTK* | 301 |
| Trichodesmium erythraeum IMS101_gvpK | MSLENSPEESLIVPIDKSKSNPEAGLAPLLLTVIELLRELMQAQVIR RMDAGILSDEQLERAAEGLRQLEEQVIKLCKVFDIPTEDLNLDLGE IGTLLPKSGEYYPGEKSENPSVLELLDRILNTGVVLDGTVDLGLAE LDLIHARLRLVLTA* | 302 | gvpL

| Ancylobacter aquaticus strain UV5_gvpL | MLYLYAILESPPPQKPLPPGIGGAAPLFVESHALVCAASEAADAAI AREPSQIWRHQEVVAALMEGRPVLPLRFGTVVEDSAACLRLLARH HAELSAQLDRVRHCVEFALRVAGLSELADPGLDPNATPAGLGPGA SHLRTLVRRERGWPVSSAAFPHDTLTAHAASRLLWARSPSQPDLR ASFLVQRRSASAFLDDVNALQRLRPDLGITVTGPWPPYSFSDPDLS GGRE* | 303 |
|---|---|---|
| Aphanothece halophytica (strain PCC 7418)_gvpL | MLYTYCFLFSPEKTLSLPQGFKGDLQMIEKGAIAAVVEPNLPKAEL EEDDQKLVQAVVHHDWVICELFRGLTVLPLRFGTYFRGEADLRSH LAAYEESYQQKLTALTGKVEVTLKLTPIPFSEEGSSSTAKGKAYLQ AKKQRYQQQSNYQTQQQEALEKLQEEIKKTYPQLIHDEPKENTER FYLLIDSHSFSVFGEKMEQWKQFLSSWSIEISDPLPPYHFL* | 304 |
| Aquabacter spiritensis strain DSM 9035_gvpL | MLYLYAVLEAPPPARSLPPGIGGGAPHFIEAFELVCAASETPNRSV APEPAEVWRHQQVVEALIDRAPALPLRFGTLVEDASACRRLLTRH RDALGAQLGRVRHCVEFALRVSGLPEEVAPDPGIGGGPGTSYLRT LARREAGWPPSTAVFPHDGLAAHAAERLLWARSTSQPDLRASFLV RKPNVAAFLADVSALQRVRPDLGITCTGPWPPYSFSDPDLSGVSP* | 305 |
| Bacillus-megaterium_gvpL | MGELLYLYGLIPTKEAAAIEPFPSYKGFDGEHSLYPIAFDQVTAVV SKLDADTYSEKVIQEKMEQDMSWLQEKAFHHHETVAALYEEFTII PLKFCTIYKGEESLQAAIEINKEKIENSLTLLQGNEEWNVKIYCDDT ELKKGISETNESVKAKKQEISHLSPGRQFFEKKKIDQLIEKELELHK NKVCEEIHDKLKELSLYDSVKKNWSKDVTGAAEQMAWNSVFLLP SLQITKFVNEIEELQQRLENKGWKFEVTGPWPPYHFSSFA* | 306 |
| Burkholderia thailandensis sp. Bp5365 strain MSMB43_gvpL | MNDALYLFCFARAEPLAPAWAKRAPGEPRLQLLHEGNLAAVLCD VSRSEFAGADAERRLADPAWIAGRVAVHAAAIEWTMRYSPVIPAQ FGTLFSGAGRVIALMESCHAHIGRVLDHVEGKTEWAVKGWLDRQ AAADSQAALLRADEPESAARTAGARYLRERQLQARAGQNLRDW LEQSVPPISARLQRHAVEMCSRPCRASDSEHEIVANWAFLVRNRD VPAFRRQAEAIDAEFATWGLHFDFSGPWPPYSFCAPLTEETTWSG* | 307 |
| Chlorobium luteolum DSM 273_gvpL | MPCRLTVTWKSLRTAGLLPTAKGIQGRTERMAQNILYVYCIVRQL PGADIVARYPDLVFIEAGSAYVAAKYVSPLEYSDASMKLKLADEE WLDRNAREHLSVNVMIMAQQTIIPFNFGTIFKSRESLSGFLGDYGR KLDESFDALEGREEWAVKAYCNESFLLKNLHESPAIAAIEQEIQA ASPGKAYLLKKKKEAMSASALEGVHQGHAKAVWGELAALSKEH | 308 |

TABLE 6-continued

Amino acid sequences of exemplary gvpA/B, gvpF, gvpF/L, gvpG, gvpJ, gvpK, gvpL, gvpN, gvpV, gvpW, gvpR, gvpS, gvpT, and gvpU proteins

| Species, protein; | Amino acid sequence | SEQ ID NO.: |
|---|---|---|
| | VLNRLIPEDVSGVDGRMIVNGVFLIANTDVGAFIRTTEDLGERYRD AGVFLDVTGPWPPYDFVDIPY* | |
| Dactylococcopsis salina PCC 8305_gvpL | MLYTYCLIASSPSALSLPSGFRGELQLIKQGAIAAIVEAELPLEELEE NDQKLIQAVIHHDAVICEIFQQIPLLPLRFGTYFPTEKDLLEHLDFK AEKYQKKLQEIQDKVELTLKLTPLPFSTENASPMEKQGKNYLKAK KQRYQEQTNYQSQQQAELNQLQTQINQDYPQFIHGEPKENIERFY LLIKERDRSVFSEQLEQWKKDFPTWTIEVSDPLPPYHFIE* | 309 |
| Desulfobacterium vacuolatum-DSM 3385_gvpL | MEKKKAVYLYCVTRANKFNAPGITGIDANTPVCFEHLENFVAVY NIIPLNTFVGTSAEENMKNIDWIGPRAMRHENVIERMMQESSVYPA RFATLFSSMENLRETLHLKSGLISRFLNQTQHKCEYSLKGFINRKQ LLEFLIKTKFKQEKKQLDGLSPGKKYFAQHQFNKKVETGINQWIK RRCGIFLDHLTKRNPEVSPRELFTEKTEKNNLEMMFNLAFLIHNDS KSAFLQEISQAEKEFSQTGISLVVSGPWAPYSFCKTTRGEGL* | 310 |
| Desulfomonile tiedjei DSM 6799_gvpL | MSNVLYLFCLARTGLVDHIEGTGITGTEDLILKNFSGVTAVTCEVP EDDFSGESAEIKLQDLAWVGPRAVRHDRIIEEIMQYSPVFPAPFGSL FSSEKRLGTLIESNIDAIREFLDHTADKQEWSVKGLVCKSKAVDEIF TGKLKILSETLSSSPAGMRYFKERQMRSEAEKELSGKVKAACTVV GEKLLACSNNFRQRKNISFGKAEGDKQLVVNWAFLVDHSRISYFL DQVEHANSNYQAGGLAFECSGPWPPYSFCPSLHMEPTR* | 311 |
| Desulfotomaculum acetoxidans-DSM 771_gvpL | MNLIDDCKAKYIYCIGENPGNWPSEVMGVEGSLVYHVVYRDIAA VVHDCAEQPYNSDDNNKVIDWVLGHQLVVDKACSCYSSVLPFTF NSIVKGKEDLSSHEILVNWLEDNYDNFKLKLGKIKGKKEYSVQLF LDKQVSLSLLQSESDILELQVELLGSAKGKAYFVQEKINKKIGELM ANRADSYCRQFYHEISSVVSECKLCKLKQAGRNEIMIINLVCLAGD NEVEVLGDVLEKIKSNDIAIKIKFSGPWPAYSFV* | 312 |
| Enhydrobacter aerosaccus strain ATCC 27094_gvpL | MLYVYGIADNAFEVLRGAGLLNSDVFAVPAGCLAAAASKLAQGG IETTPQGVWRHEQVLRQLMQDHAVLPLRFGTICRDRETLTDRLME ASDDLVRGLGRVRGKVEIALRIVDEREHEAHPVPSETPTVDAIGGG RGTAYLRARRRHHAAEMGREARAERVGKMLSAYIDVGAEDLVC SVAPEGDHAVSVSCLLGRDQLATLQAALERFQSDHPAIGLSWTGP WTPYSFVAPSLFGVGLP* | 313 |
| Legionella drancourtii LLAP12_gvpL | MNKALYLFCLTPASDLPMMEGELLPNFSPLFIHPFQTFNAILSWVP AKEYQEQSTDSNLINTEEFMQRVFFHELVVEKIMRDEAVFPIGFGT LFSSIASLEEQILTHQTLISSCLANLNQKDEYAVRVYLNQDKALESL LSVMLQERESSWASSSPGVQYLKKQQLHNEIQRNLNQHLGGMLD EVLSMFQRHATDFKSRENTAQSSDIHGTSILHWAFLIPRVVSSIFKE QVDLMNAKYNPFGLHFVLTGPWPAYSFCTLQSVEAP* | 314 |
| Lyngbya confervoides BDU141951_gvpL | MRWHRSEAVISYCDLSMIYLYALCPNSTETNNLPEGIGTAQVEVLT VGTLGAVIERDVDIAQIQKDDAQLMAAVLAHDRILSHLFTYSPLLP LRFGTQPFSNSEAVTTFLKTQGETYRQKLSHLQDRAEYLVKLIPQPL DLPAIASDLKGREYFLAKKQRLQDHTAALNQQADELQTFLTDLAT QDIPLVRSAPQDHEERLHVLLSRDTDTTEQVIMTWQEQLPNWQVV CSEPLPPYHFAA* | 315 |
| Octadecabacter antarcticus 307_gvpL | MKRLYVYGIVGATSFDDPLPNGHDEASVFALVSGDIAVAVSFVER SAVEASAANVWLHDNVLSALMTRYAVLPMRFGTIAVGATQLLEG IVKRQKQLMKDLMRLNENVEIALHISGKNWEKVNQKVTKKNTDQ AITQGTAYLLGRQQSLYGSDKTQLLVQNVRRAIRSGLDPLMKDVI WPIDKPQALPFKASCLINRNDVASFVQIVNDIAAQNLDARVTCTGP WAPYSFVGKSGVEGET* | 316 |
| Octadecabacter arcticus 238_gvpL | MTKLYVYGIVGATHFDVKLPNGHDEAPVFAIVSGDLAVAVSSLER SAVEASAANVWLHENVLSALMEGHAVLPMRFGTIATGAAQLLGD IVKRRGQLMKDLTRLDGKVEIALRISGKNREKVEQRIAGQIVDTNV TQGVAYLQEKQQNLYGSFYTQSSVQCARRAIRSQLDPFIVEAIWPT DEPQMLPFRASCLIKKGDIARFVQTVDDVVVKVSDIRVTCTGPWA PYSFVGQSGSEAET* | 317 |
| Pelodictyon phaeoclathratiforme_ gvpL1 | MVAIQERLIYIFCVTSEPPLLQQYQLQKGICVVDVDGLFVTTMDVT DNDFAENQLQSNLSDVVWLDTKVREHLDVITSIMQHVKSLIPFNF GTLYKSESSLMQFIIKYAEEFKKNLVYLEEKEEWAVKLYCNKNKI VENITHLSKKVSDINALIQNSSIGKAYILGKKKNEIIENEIINIYNTYS KKIFTKFSILSEEFRFNPIPNNETLEKEDDMILNVVLLLNKANVESFI ETSDQLIIQHQNIGLNIEITGPWPCYSFINISH* | 318 |

TABLE 6-continued

Amino acid sequences of exemplary gvpA/B, gvpF, gvpF/L, gvpG, gvpJ, gvpK, gvpL, gvpN, gvpV, gvpW, gvpR, gvpS, gvpT, and gvpU proteins

| Species, protein; | Amino acid sequence | SEQ ID NO.: |
|---|---|---|
| Pelodictyon phaeoclathratiforme_gvpL2 | MPLIIYAIFDSINYIDSFSSYVDAISLKSKIKLEIISTSTLSAIVSRTTDE KKQACQNDVMIYATIIGDIAAKYSILPMRYGSIVSSPFDVTELLKN HNETFVTIIKKITDKEEYSLRILYSHQDKEKNNIEDLFDLPQNVPDIL HGNTDSKKYLLNKYIKHLSEEKRLQYIDKIQSIVACNLQKITDLIVY NKQTTTGFIVDAVFMIERSKKSELLDLVIQMQTLFSEHNVVLSGPW PPYNFSNINIG* | 319 |
| Psychromonas ingrahamii 37_gvpL1 | MKNSNHSGLDPNQALYLYCFVHADSIQSVTSQAIEKDSPVFIYQW QDIAAVLSHVPTSYFTGYDDEEPEQTIARILPRTQLHEQVIEEVMRQ SPVFPAQFGTLFSSQESLEQEISQQYLAITHTLKEVSGSVEWAVKG VLDRGVAEKALYSQQLTEQQNSLSSSPGMRHLQEQRLRRETQSKL NSWLHQLYTDIATPLSELSGDFFQRKIPSSIEEGKEVILNWAFLVPE SAGDDFHAQIDKLNQRLNSFGLVIQCSGPWPPYSFCNQSS* | 320 |
| Psychromonas ingrahamii 37_gvpL2 | MKNSNHSGLDPNQALYLYCFVHADSIQSVTSQAIEKDSPVFIYQW QDIAAVLSHVPTSYFTGYDDEEPEQTIARILPRTQLHEQVIEEVMRQ SPVFPAQFGTLFSSQESLEQEISQQYLAITHTLKEVSGSVEWAVKG VLDRGVAEKALYSQQLTEQQNSLSSSPGMRHLQEQRLRRETQSKL NSWLHQLYTDIATPLSELSGDFFQRKIPSSIEEGKEVILNWAFLVPE SAGDDFHAQIDKLNQRLNSFGLVIQCSGPWPPYSFCNQSS* | 321 |
| Serratia sp. ATCC 39006_gvpL | MTMNTEAQTEQAIYLYGLTLPDLAAPPILGVDNQHPINTHQCAGL NAVISPVALSDFTGEKGEDNVQNVTWLTPRICRHAQIIDSLMAQGP VYPLPFGTLFSSQNALEQEMKSRATDVFVSLRRITGCQEWALEATL DRKQAVDVLFTEGLDSGRFCLPEAIGRRHLEEQKLRRRLTTELSD WLAHALTAMQNELHPLVRDFRSRRLLDDKILHWAYLLPVEDVAA FQQQVADIVERYEAYGFSFRVTGPWAAYSFCQPDES* | 322 |
| Stella vacuolata-ATCC-43931_gvpL | MLYLYAVLEALPAARTLPAGIGGGELLFVEAFELVCAASETPERAI APEPTQVWRHQQVVEALIDCAAALPLRFGTLVEDAVACRRLLTRH REALCAQLDRVRHCVEFALRVSGLREEVGSDHVIGGGPGVSYMR ALARREASWPPSTGTFPHDGLAAHAADRLLWSRSASQPDLRASFL VLKPNVAAFLADVSALQRMRPDLGITCTGPWPPYSFSDPDLSGMS P* | 323 |
| Thiocapsa rosea strain DSM 235 Ga0242571-11_gvpL | MDAFYCFCFAPACLASDLRFDDCGWEDPIEIRRLAGLDVILSRVPL GRFAGAEAEQRLADLEWLVPRAQAHDRVITRTMERSTVFPLTFAT LFSSLPALALEVAARRRALLDFFERMAGREEWAVKVSMDRERVIA TRMQSLYPEGGDVPAGGRGYLLKQRRRGEAEQAIGPWLKGQIGC LDEALRPSCETLLIRPLRDEMVASRACLVARDLGPSLSEAIERSREA FADQGLDLHCSGPWPLYSFCGTP* | 324 |
| Trichodesmium erythraeum IMS101_gvpL | MSYYVYGFLYLPESCLALPKGMEKEVELVPYQNIAAVVEANVSIE AIQETEEKLLEAILAHDRVVREIFQQVSMLPLRFGNAFALRENIIND LQNNQQQYLNILTKLQQQAEYTITFTPVSYPSTLEVSKVRGKAYLL AKKQQFEQQQAFQTKQRQQWENIRQLIFKNYPKAVFRDSTESKIK QVHLLANRDARVITTEELSTWQTECSYWQITLSEQLPPYHFV* | 325 |
| gvpN | | |
| Anabaena-flos-aquae_gvpN | MTTTKVNHKRAVLRLRPGQFVVTPAIERVAIRALRYLKSGFPVHL RGPAGTGKTTLAMHLANCLDRPVMLLFGDDQFKSSDLIGSESGYT HKKVLDNYIHSVVKLEDEFKQNWVDSRLTLACREGFTLVYDEFN RSRPEVNNVLLSALEEKILSLPPSSNQPEYLSVNPQFRVIFTSNPEEY AGVHSTQDALMDRLVTISMPEPDEITQTEILIQKTNIDRESANFIVR LVKSFRLATGAEKTSGLRSCLMIAKVCADNNIPVTTESLDFPDIAID ILFNRSHLSMSESTNIFLELLDKFSAEELEILNNRVTGDNDFLIDNSQ FVSQQLAGQPN* | 326 |
| Ancylobacter aquaticus strain UV5_gvpN | MTSEAASKDPISLLSGFGAGAASSGPKAGGRSTPSALTPRPRTGFV EAEQVRDLTRRGLGFLNAGYPLHFRGPAGTGKTTLALHVAAQLG RPVIIITGDNELGTADLVGSQRGYHYRKVVDQFIHNVTKLEETANQ HWTDHRLTTACREGFTLVYDEFTRSRPETHNVLLGVFEERMLFLP AQAREECYIKVHPEFRAIFTSNPQEYAGVHASQDALADRLATIDVD YPDRAMELAVASARTGMPEASAARIIDLVRAFRASGDYQQTPTMR AGLMIARVAAQEGFEVSVDDPRFVQLCSDALESRIFSGQRAEEVA REQRRAALHALIDTHCPSAAKPRARRAGGAVRASIEGAQS* | 327 |
| Aphanizomenon flos-aquae NIES-81_gvpN | MTKTNHKRAVLRVRPGQFVVTPAIEQVAIRALLYLKSGFPIHLRGP AGTGKTTLALHLAHCLDRPVMLLFGDDEFKSSDLIGSESGYTHKK LLDNYIHSVVKVEDEFKQNWVDSRLTLACREGFTLVYDEFNRSRP EVNNVLLSALEEKILSLPPSSNQPEYLSVSPQFRAIFTSNPEEYCGV HSTQDALMDRLVTINMPEPDEITQTEILIQKTNIQKESAHLIVRLVK | 328 |

TABLE 6-continued

Amino acid sequences of exemplary gvpA/B, gvpF, gvpF/L, gvpG, gvpJ, gvpK, gvpL, gvpN, gvpV, gvpW, gvpR, gvpS, gvpT, and gvpU proteins

| Species, protein; | Amino acid sequence | SEQ ID NO.: |
|---|---|---|
|  | SFRIATGAEKTSGLRSCLMIAKVCADNNLVAEPENSFFQEIAMEILS NRTHLSVNESTDIFLDVISQFSNKEIEILNDAELGSLPTMDTLANTD LGNDVPLEKEASDYVIQQKNNEFKGFQKPSTKVLN* |  |
| Aphanothece halophytica (strain PCC 7418)_gvpN | MTTVLHARPKGFVSTPTIDRISRRAWRYLQSGFSIHLRGPAGTGKT TLAMHLADLLNRPIMLLYGDDEFKSTDLIGSNTGYTRKKVVDNYI HSVVKEEDELRQQWVDSRLTMACREGFTLVYDEFNRSPPEVNNV LLSALEEKLLVLPPDSHRSEYVRVSPNFRAIFTSNPEEYWGVHGTQ DALLDRVVTINVPEPDLETQREIIVQKVGINADDGDMIVNFVRNFR DRAEMENSSGLRSCLMIAQVCHQHEIPVQTSNEDFQDICYDILTSR CPLSTQESISLLEQLFREYELELVVEDEDEDVPSVIVEGETEDLSSDE KPHLRLSHPFGNTEND* | 329 |
| Aquabacter spiritensis strain DSM 9035_gvpN | MSTEPAPLVSPSQDVETTPQRPARPEPAEALAVGYRLSARPASPAT LTPRPRADFVETDQVKDLTRRGLGFLRAGYPLHFRGPAGTGKTTL ALHVAAQLGRPVIVITGDNELGTADLVGSQRGYHYRKVVDQFIHN VTKLEETANQRWTDHRLTTACREGYTLVYDEFTRSRPETHNVLLG VFEEKILFLPAQAREECYIRVHPDFRAIFTSNPQEYAGVHASQDAL ADRLATIDVDYPDRGMELAVASARTGLGETEAARIIDLVRAFRAS GDYQQTPTMRASLMIARVAAQEGLRVSIDDPGFVQLCMDALESR MFSGARLEAATRETSRAALLALLAVHCPSEAPIVRVTAARRAKKA DAS* | 330 |
| Arthrospira platensis NIES-39_gvpN | MTTVLRAVPKGFVNTPAIERITVRALRYLQSGFSVHLRGPAGTGKT TLALHLADLLNRPIMLIFGDDELKSSDMIGNQTGYTRKKVVDNFIH SVVKLEDSLKQNWIDSRLTLACREGFTLVYDEFNRSRPEVNNVLL SALEEKLLVLPPNNSRSEYIRVNPHFRAIFTSNPEEYCGVYSTQDAL LDRLITMNMPEPDEATQQEILIQKVAVTPEEAQTIVTLVQQFREAT HAIAPSKIQTVARQQTNADKASGLRPSLMLARICQEHNIPIVPIDPD FQEVCRDILLSRAIGDITELESRLHQIFDHLSGLENDQIIALPPREELT TSSVPNNLSDTEQKIYTYIKDSDGARVSEIEIALGLNRVQTTDALRS LLRKSYLTQQDNRLFVVYEGD* | 331 |
| Bacillus-megaterium_gvpN | MTVLTDKRKKGSGAFIQDDETKEVLSRALSYLKSGYSIHFTGPAG GGKTSLARALAKKRKRPVMLMHGNHELNNKDLIGDFTGYTSKKV IDQYVRSVYKKDEQVSENWQDGRLLEAVKNGYTLIYDEFTRSKPA TNNIFLSILEEGVLPLYGVKMTDPFVRVHPDFRVIFTSNPAEYAGV YDTQDALLDRLITMFIDYKDIDRETAILTEKTDVEEDEARTIVTLVA NVRNRSGDENSSGLSLRASLMIATLATQQDIPIDGSDEDFQTLCIDI LHHPLTKCLDEENAKSKAEKIILEECKNIDTEEK* | 332 |
| Bradyrhizobium oligotrophicum S58_gvpN | MLRSDRAAIAGGQRGSRAQGDAVARNDAAAGSRAAIAQISPRPD ADNAALSPAPRTDLFENPQLASMAARALTYLNAGIPVHLRGPAGT GKTTMAMQLAARLGRPVVLLTGDDGLTAAHLVGREIGTKSRQVV DRYVHSVRRVETETESSMWCDAVLAQAVVEGLTFVYDEFTRSPPQ ANNPLLSVVEERILIFPAGSRKERLVHAHPEFRAILTSNPEEYAGVS RPQDALLDRLITFDLDDYDRETEIGIVSNRTGLAYAEAGVIVDLVR GVRRWPKAHHPPSMRSAIMIARIVARELITPSVDDPRFVRLCLDVL AAKAKPTDRDDRDRFAATLLRLMNNHCPAGAIDGG* | 333 |
| Burkholderia thailandensis sp. Bp5365 strain MSMB43_gvpN | MEASAEFVQTPAVRNLTERALTYLGAGYGVHLAGPSGTKTTLA FHIAAQLGRQVVLMHGDDELGSADLVGRGAGYRRSRVVDNFIHS VVKTEEEMTTTWIDNRLTTACQHGLTLIYDEFNRSRPEANNALLP VLSEGILNLPNRMTGAGYLTVHPGFRAIFTSNPEEYVGVHKTQNA LMGRLITIQVGHYDRETEVEIVRARSGIARADAERIVDLTRRLRDA DDNGHHPSIRAAIALARALSYCGGEATPDNAGYVWACRDILGVDL EQDARTRSQAGRRTKARR* | 334 |
| Chlorobium luteolum DSM 273_gvpN | MRAAVNDNEMNTVLAPRPMANFVETEYIRDITERGLTYLKAGFPV HFRGPSGTGKTTVAMHLAGKIGRPVVVIHGDSEYKTSDLIGSEQG YKFRRLNDNFIHSVHKYEEDMSKQWVNNRLSIAIKKGFTLVYDEF TRSRPEANNILLPILQEKMLSTSASNEEDYYMKVHPEFRAIFTSNPE EYAGVNRTQDALRDRMVTMDLDYFDYETELRVTHAKSELTLEDS EKIVQVVRGLRESGKTEFDPTVRGSIMIARTLHIMQVRPEKTNDAV RKVFQDILTSETSRVGSKTNQEKVRAIVNDLIEAYL* | 335 |
| Dactylococcopsis salina PCC 8305_gvpN | MTTVLHARPKGFVSTPTIDRISGRAWRYLQSGFSIHLRGPAGTGKT TLAMHLADLLNRPIMLLYGDDEFKSTDLIGSNTGYTRKKVVDNYI HSVVKEEDELRQQWVDSRLTMACREGFTLVYDEFNRSPPEVNNV LLSALEEKLLVLPPDSNRSEYVRVSPNFRAIFTSNPEEYWGVHGTQ DALLDRVVTINVPEPDLETQQEIITQKVGINANDGEKIVNFVRQFR DRAAVKNSSGLRSCLMIAQVCHQHEIPVQTSDEGFRDICYDILSSR | 336 |

TABLE 6-continued

Amino acid sequences of exemplary gvpA/B, gvpF, gvpF/L, gvpG, gvpJ, gvpK, gvpL, gvpN, gvpV, gvpW, gvpR, gvpS, gvpT, and gvpU proteins

| Species, protein; | Amino acid sequence | SEQ ID NO.: |
|---|---|---|
| Desulfobacterium vacuolatum_DSM 3385_gvpN | MSASMSSMKETRQRMSAPEQDNVVPEAGSDFVETPYVKDITDRA LAYLHVGYPVHFSGPAGTGKTTLAFHVAAKLKRTVMLIHGDDEF GSSDLIGKDSGYRKAKVVDNYIHSVVKTEESMNTVWADNRLTIAC QQGCTLVYDEFTRSRPEANNAFLSVLEEKILNIPSLRDIDQGYLQV HPEFRAIFTSNPEEYAGVHKTQDAMMDRLITITLDHFDRDTEVQVT MSKSDLPQKDAEKIVDIVRKLRKTGVNNHRPTIRACIAIGKILKHM GGGASKDNFVFKQICRDVLNVDTTKVTRDGEPLLPRKIDELINSL* | 337 |
| Desulfomonile tiedjei DSM 6799_gvpN | MNGAELRIASIETEVITANNENIVPEAGDRFVNTPHVEELTARAMA YLEVGYSVHFSGVAGTGKTTLAFHAAAKLGRPVILVHGDHEFGSS DLIGRDAGYKKSRLVDNFIHSVVKTEEEMRSLWVDNRLTTACRD GYTLIYDEFTRSRPEANNVLLSILEEKILNLPSLRRTGEGYLEVHPSF RAIFTSNPEEYAGVHKTQDALMDRIITINVDHYDRETEIEITRAKSG VCKQDATVIVDIIRELRLLGVNNHRPTIRAAIAIARVLAHTGEHAD QHNSVFQWLCKDVLSTDTVKVSRGGSPLMAKKVEEVIRKVCGRT GGKRSGKPVGSKEETSE* | 338 |
| Desulfotomaculum acetoxidans_DSM 771_gvpN | MQLNGLDKNSIINPVVLSDFVVTDYISNVVDRALAYIKAGFAIHLR GRSGTGKTSIAMYISSKLNRPTLVIHGDEEFRTSDLIGGRYGYRIRK TIDNFVQSVVKVEEDLVERWVDSRLTTACKNGYTLVYDEFTRSRP EANNILLSVLQERLLDISVARGAEEGYVKVHPDFTAIFTSNPEDYA GVYGSQDALRDRMVTLDLDNYDKETEISIIKSKSKLSREDSERVVN ILRDLRELGDCEYGPTIRGGIMIAKTLQVLGAPVDKNNEMFRQICE EVLASETSRAGNLQALRKVRKVINELFNKYA* | 339 |
| Dolichospermum circinale_gvpN | MSITKVNHKRAVLRLRPGQFVVTPAIERVVIRALRYLRSGFPIHLR GPAGTGKTTLGMHLANCLDRPVMLLFGDDQFKSSDLIGSESGYTH KKLLDNYIHSVVKVEDEFKQNWVDSRLTLACREGFTLVYDEFNRS RPEVNNVLLSALEEKILSLPPSSNQPEYLSVNPQFRVIFTSNPEEYCG VHSTQDALMDRLVTINMPEPDEITQTEILIQKTNIGRESANLIVRLV KSFRLATGAEKTSGLRSCLMIAKICADHDIPASTEDLDFREIAIDILF NRAQLSISESTDIFMGLLEQFSAEEIKVLNDTHFPTDELLINNSQFIT QELVTQPNTELATDIPQELRKTEQN* | 340 |
| Enhydrobacter aerosaccus strain ATCC 27094_gvpN | MSMDQAEEIGVVTTIEPRPRADFVRTQSVEATARRALGYLNAGFS VHFRGPAGTGKTTLALHLAALLGRPMVMITGDEEMLTSTLVGTQ HGYHPFRRVVDRFIHTVTKTEETADKRWADHRLTTACREGYTLIYD EFTRSRPEANNVLLSVLEEGLLVLPAQNQNEPYIKVHPNFRVIFTSN PQEYAGVHDAQDALGDRIVTIDMGHADRELELAIAAARSGLPPTQ VAPIVDMVREFRETGEYDQTPTLRTSIMICRMMSQERLAPTIEDQQ FVQICMDILGGKSLPGGKGDNKRAQQQKMLLSLIEHHCPARSFTS VGEV* | 341 |
| Isosphaera pallida_ATCC-43644_gvpN | MDYESTALQLKPRPDFVATPWVRELADRALGYLTAGYPVHFSGP AGTGKTTLAMHLAALVNRPVLLHGDDEFGSSDLVGDHLGFRST KVVDNFIHSVVKTEQSVSKTWVDHRLTTACRHGFTLIYDEFNRSR PEANNILLTILEERLLELPPIAGGRDGSGPLRVHPEFRAIFTSNPEEY AGVHKTQDALLDRMITISMGGHDEATETEITAAKSGLSRDEAARI VELARAVRALKPLRHPPTIRSCLMIAKVAALRKVPIDPNDALFLAI CRDVLRIDALPVDDPEATFAELIRRVFAPTPAVAPPRVPTTGFAAN RVVPIPRRPLAASASPPPGANGHAHLR* | 342 |
| Legionella drancourtii LLAP12_gvpN | MMTQENNGSLTDSKNNDKLIRFVNNRSDNILLEASEEFTETPHIRGI SERALAYLDIGYPIHLLGPAGTGKTTVALHIAAQLGRPVILHGDDE FTGADLVGRGTGYHHSKLVDNFIHSVLKTEEEMTTMWTDNRLTT ACEQGYTLIYDEFNRSRAEANNALLSVLSEGILNLPGRRERDGIGY VDVHSNFRAIFTSNSEEYVGIHKTQNALADRLIAIKMDYPDQQSEI QIIEKKSTLPRKDIEIIVNLARELRLKSEKRPSIRGCIAIARVLAYHNR HAHADDPIFQAVCQDIFGISKEFLKQLLHPMDSGLQKRSEKNQESI KKYKTKNQKL* | 343 |
| Lyngbya confervoides BDU141951_gvpN | MSTVLQARPRNFVSTPAVERIARRALRYLQSGYSVHLRGPAGTGK TTLALHLADLLSRPIMLVFGDDEFKTSDLIGNQSGYTRKKVVDNYI HSVVKVEDELRHNWVDSRLTLACREGFTLVYDEFNRSRPEVNNV LLSALEEKLLVLPPSGHRPEYLRVNPHFRAIFTSNPEEYAGVHGTQ DALLDRLITIHMPEPDELTQQQILIQKVGIEPADALMIVRLVKAFKS QMGNHSATSLRPSLMIANICHEHGVAMMTEDADFRDVCSDVLLS RVTNELSPATHTLWDLFNELTASADVLGPESNSTDVSPQPEADKP VETKGSKGKSTTKSKAKESAKASEEADEAGDDSASAPELDEIESSI LTFLTARESASLSEIESELSLTRFKAVDALRSLVEAGYLQKQNGAG KPAIYGLVPEES* | 344 |

TABLE 6-continued

Amino acid sequences of exemplary gvpA/B, gvpF, gvpF/L, gvpG, gvpJ, gvpK, gvpL, gvpN, gvpV, gvpW, gvpR, gvpS, gvpT, and gvpU proteins

| Species, protein; | Amino acid sequence | SEQ ID NO.: |
|---|---|---|
| Microcystis aeruginosa NIES-843_gvpN | MTVTETQTRRAVLSLRPGQFVVTPSIDQIATRALRYLNSGFSIHLCG PAGTGKTTLAMHLANCLARPVMLIFGDDDFTSSDLIGSQSGYTHK KLMDNYIHSVLKVEDELKHNWVDSRLTMACREGFTLVYDEFNRS RPEVNNVLLSALEEKILTLPPTSHQPDYLQVNSQFRAIFTSNPEEYC GVHATQDALMDRLVTINMPEPDQLTQTEILAQKTGIGREDALFIVN LVKTFRVKTATEKTSGLRSCLMIAKVCASHDIAANSADSDFRDICA DVLLSRTNLSVDKSRAILWEILEDNPLESLSFLEEEEPSDAQVSTSE PSTGNQSLKAIQSLLRGNLPQRKD* | 345 |
| Nostoc punctiforme ATCC 29133_gvpN | MTTVLNASPQRFVNTPAVQRIAQRALRYLQSGFSIHLRGAAGVGK TTLAMHLADLLNQPIILLFGDDEFKTSDLIGNQLGYTRKKVVDNFI HSVIKVEDEVRQHWVDARLTLACKEGFTLVYDEFNRSHPEVNNV LLSVLEERLLVLPTNQHRAEYIRVHPQFRAILTSNPQEYCGVHATQ DALMDRVITIDMPTPDELSQQEIVVHKTGIDSEKAEVIVRIVRTFWS RSGSGQGGGLRSCLMIAKICHEHEISVNPGDPSFQDICADILLSRTN QPLIEATRLLEEVLSEFYHRINTQSPSEIIPNNQNQIVLEQRVPYEH EVYNYLCNSPGRRFSELAVELGIDRSQIVAALKSLREQGVLVQMQ GNAESPSISQTVAFDSGHLINK* | 346 |
| Nostoc sp. PCC 7120_gvpN | MTLTANNKKRAVLRVRPGQFVVTPAIEQVAIRALRYLTSGFAIHLR GPAGTGKTTLAMHLANCLDRPIMLIFGDDEFKSSDLIGSESGYTHK KLLDNYIHSVLKVEDEFKQNWVDSRLTLACREGFTLVYDEFNRSR PEVNNVLLSALEEKILTLPPSSNQPEYLHVNPQFRAIFTSNPEEYCG VHSTQDALMDRLVTINMPEPDELTQTEILAQKTALNRADALLIVRL VKAFRSRTGGEKTSGLRSCLMIAKVCAEHNILVSPQSSDFREICAD VLFNRTNWSASEAATIFLELLNHLDLQQIEEFKNSIIPEDTDAIAEG GFPTIIDSHFGTLDSEVLEQPGVEDSIPFEQEIYLYLQQYKSAALAL VQQEFELSRTVATNALNSLEQKGLVSKNNHVYTIEEPNQS* | 347 |
| Octadecabacter antarcticus 307_gvpN | MNSNLRATNSGGPDISKTMMPEAREDFVQTESVKSISRRALAYINA GYSVHFRGPAGTGKTTMAMHTAALLGRPVVLITGDEEMITSNLVG AESGYNYRKVTDNYIHTVSKIEESSDRSWNDHRLTTACREGYTLIY DEFTRSRAEANNVLLSVLEEGILVLPAQNRGEPFIKVHPNFRVIFTS NPQEYAGVHEAQDALSDRIVTIDIGEADRELEVSIASSRSGLEVAK TEPIVDMVRAFRDTGEYDQTPTLRACIVICRMVANEKLNTTIDDPF FVQICLDVLGSKSTFGGKEHDKRTQQRKLLLDNLKHYCPSKVSTK PSAKDDESKSTLIQVSSRGSL* | 348 |
| Octadecabacter arcticus 238_gvpN | MMPEARKDFVQTDSVKSVSRRALAYINAGYSVHFRGPAGTGKTT MAMHTAALLGRPVVMITGDEEMVTSNLVGAESGYNYRKVTDNYI HTVSKVEESSDRSWNDHRLTTACREGYTLIYDEFTRSRAEANNVL LSVLEEGILVLPAQNRGEPFIKVHPDFRVIFTSNPQEYAGVHDAQD ALSDRIVTIDIGAADRELEVSIASSRSGLEVAKTAPIVDMVRAFRDT GEYDQTPTLRACIMICRMVANEKLNPTIDDSYFVQICLDVLGSKSM FGAKEQGKRTQQEKLLLDNLSHHCPSPPPSKPSAKEAEAKPRSIQA TSRGPA* | 349 |
| Pelodictyon phaeoclathratiforme_ gvpN | MRRQGCDSEMNTVLEPKPMPNFVETDYIRDITSRGLTYMKAGFPV HFRGPSGTGKTTVALHLASKIGRPVVIIHGDSEYKTSDLIGSEQGYK YRRLDDNFIHSVHKYEEDMTKQWVNNRLTIAIKKGFTLVYDEFTR SRPEANNILLPILQEKMMSTSSSNEEEYYMKVHPEFRAIFTSNPEEY AGVNRTQDALRDRMVTMDLDYFDYETELMITHAKSGMSLDDAE KIVKIVRGLRESGKTEFDPTIRGSIMIAKTLNVLNARPDKTNELFKK VCQDILTSETSRVGSKTNQERVRGIVNELIDLHS* | 350 |
| Phormidium tenue NIES-30_gvpN | MNTVLQARPRNFVSTPTLERTSIRALRYLQSGYSIHLKGPAGTGKT TLALHLADLLARPIMLLFGDDEFKTSDLIGNQSGYTRKKVVDNYIH SVVKVEDELRHNWTDSRLTLACREGFTMVYDEFNRSRPEVNNVL LSALEEKLLVLPPSNNRAEYIRVSPHFRAILTSNPEEYCGVHGTQD ALQDRLITINMPEPDELAQQQILVQKVGIDSSAALQIVQLVKAFQS AVAPDMVSSLRPSLMIATICHDHDILPLAENADFRDVCSDILLARS KEPAPDATRHLWNLFNRFVVSQAALVNDLSLKPEAHPTARFHGEE EDDAPLQPLEALVESDIDDVAVEDQPVIGPQDLQGETLPEAVIPEP QGETVVETPAEAEALPEEIARVQVSPDDIETRIFDYLDATGTASLV NIEAALDLNRFQAVNAVKSMLDQGLIEKQETDGQLQGYQLSSN* | 351 |
| Planktothrix agardhii str. 7805_gvpN | MTTVLQARPKGFVNTPTIEQLTIRALRYLQSGFSLHLRGPAGTGKT TLAMHLADLLNRPIVLIFGDDELKSSDLIGNQLGYTRKKVVDNFIH SVVKLEDELRQNWIDSRLTLACKEGFTLVYDEFNRSRPEVNNVLL SALEEKLLVLPPNNSRSEYIRVNPHFRAIFTSNPEEYCGVYGTQDAL LDRLITIDMPEPDDETQQEILIQKIGISPEDAKNIIEIVKIYLEITTQKK EIKPVQNGKAARPHIDKASGLRPGLIIAKICHEHDISIQENNQDFIKV CADILLSRTNLSLTEAQNKLEKVIKTVLTDGDTSNNSFLPPSETQLT | 352 |

TABLE 6-continued

Amino acid sequences of exemplary gvpA/B, gvpF, gvpF/L, gvpG, gvpJ, gvpK, gvpL, gvpN, gvpV, gvpW, gvpR, gvpS, gvpT, and gvpU proteins

| Species, protein; | Amino acid sequence | SEQ ID NO.: |
|---|---|---|
| | ENNSLEIEEQVYQYLQKTTSARVSEIEVALGLNRVQTTNVLRSLLK QGHLKQQDNRFFAVNKQGELIQP* | |
| Planktothrix rubescens_gvpN | MTTVLQARPKGFVNTPTIEQLTIRALRYLQSGFSLHLRGPAGTGKT TLAMHLADLLNRPIVLIFGDDELKSSDLIGNQLGYTRKKVIDNFIHS VVKLEDELRQNWIDSRLTLACKEGFTLVYDEFNRSRPEVNNVLLS ALEEKLLVLPPNNSRSEYIRVNPHFRAIFTSNPEEYCGVYGTQDAL LDRLITIDMPEPDDETQQEILIQKIGISPEDAKNIIEIVKIYLEITTQKK EIKPVQNGKAARPHIDKASGLRPGLIIAKICHEHDISIQENNQDFIKV CADILLSRTNLSLTEAQNKLEKVIKTVLTDGDTSTNSFLPLSETQLT ENNSLEIEEQVYQYLQKTTSARVSEIEVALGLNRVQTTNVLRSLLK QGHLKQQDNRFFAVNKQGELIQP* | 353 |
| Psychromonas ingrahamii 37_gvpN1 | MSIENLNNVSEIKIEQSDDDHIYPEASEDFVETPYIKEVTERAMLYL DAGYPVHFAGPAGTGKTTLAFHIAALRQRPVTLIHGNHEFGTSDLI GKESGYRRHRVVDNYVHSVVKEEEELQSLWSDNRLTTCCRNGDT LVYDEFNRSTPEANNVLLSILEEGILNLPSSRSDGYLEVHPQFRAIFT SNPQEYAGTHATQDALVDRMITIMLHYPDRHTEVRVAIAKSGINS DEAGSIVDIVNEFRELCGSKIVSSGPKTMPTVRASIAIARVLVQKGE HAFRDNTFFHRICRDVLCMYTQQVSFSNRSVLDKQLEDLIMKFCP ATYKSSGSKIRA* | 354 |
| Psychromonas ingrahamii 37_gvpN2 | MSINNLNISTIKIEQPENDNIYPEASAEFVQTPYIQEVTERALLYLDA GYPVHFAGPAGTGKTTLAFHIAALRKRPVTLIHGNHEFGSSDLIGK ESGYRRHRLVDNYVHSVMKEEEELKSLWVDNRLTTCCRNGDTLV YDEFNRSTPEANNVLLSILEEGILNLPSLRSMGDGYLEVHPSFRAIF TSNPQEYAGTHATQDALVDRMITIMLNYPDRDTEVRVAVAKSGIS NEEAGFIVDIVNEFRELSNHKSLSSGQKSMPTVRASIAISRVLIQKG EHAFRDNVFFHRVCHDVLCMYIQKISPSNRSFLDKQLEVLIGKFCP AAKSALVPKVVK* | 355 |
| Rhodobacter capsulatus SB 1003_gvpN | MTIPRDLPWGDARTPLFEDEELRSLLDRAEIYLREGIAIHFRGPAGV GKTTLALHLAQRFARPVTFFVGNDWLGRADIFGRDLGETVSTVQD HYISSVRRAERKSRIDWQEAPLARAMRDGHVLVYDEFSRSRPEAN AALLSVIEEGVLPLSDPAAGRSHIVAHPDFRVILTSNPRDYVGVQA VPDALLDRMITFSLDGMSFETEVGIVATAARTDPADARAICALIHL LRAEKPGTMEISMRSGIMIARLARAAGVAPDPADPVFVQICADVL GTRMRGSDIDDVMALLLRPDPAPAACAGGAR* | 356 |
| Rhodobacter sphaeroides 2.4.1_gvpN | MTVLSPSLPHAAGIDAALVENPWLGLRRSGRYFQNAETEALFARA LGYARAGVCVHLAGPAGLGKTTLALRIAQALGRPVAFMTGNEWL GSRDFIGGEIGQTVTSVVDRYIQSVRRTEQSARIDWKESILGQAMR CGQTFIYDEFTRASPEANAALLSVLEEGVLVSTDGASRHQYIEAHP DFRVLLTSNPHEYQGVKAAPDALIDRMVTLRLEEPSAPTLAGIVAL RSGLDPATARRIVDLILSVQRSGEMQAPPSMRTAILVARLAAPLRL AGRLSDAALAEIAADVLRGRGLEADAAAFEAKLAAPTPGETAR* | 357 |
| Serratia sp. ATCC 39006_gvpN | MIKQNTVSQYTVDDDLVVPEASEHFVATSYVNDIIERALVYLRAG YPVHFAGPSGIGKTTLAFHLAALWGRPVTMLQGNEEFVSSDLTGK DIGYRKSSLVDNYIHSVLKTEEQMNRMWVDNRLTTACRNGDMLI YDEFNRSKAETNNVLLSVLSEGILNLPGLRGVGEGYLDVHPEFRAI FTSNPEEYAGTHKTQDALMDRMITINIGLVDRDTELQILHARSELE LKEAAYIVDIIRELRGNEHETKHGLRAGIAIAHILHQQGIKPRYGDK LFHAICYDVLSMDAAKIQHAGRSIYREMVDGVIRKICPPIGSDTVK ASTQKIKAVE* | 358 |
| Stella vacuolata_ATCC-43931_gvpN | MSTEPAPVMPPSTDIEFGSQRPARPKPAEALAVGYRLSARPAAPST LTLRPRADFVETDQVKDLTRRGLGFLRAGYPLHFRGPAGTGKTTL ALHVAAQLGRPVIVITGDNELGTADLVGSQRGYHYRKVVDQFIHN VTKLEETANQRWTDHRLTTACREGYTLVYDEFTRSRPETHNVLLG VFEEKILFLPAEAREECYIRVHPDFRAIFTSNPQEYAGVHASQDALA DRLATIDVDYPNRAMELAVASARTGLAEAEAARIIDLVRAFRASG DYQQTPTMRASLMIARVAAQEGLRISVDDPGFVQLCMDALESRIF SGARQEADARARHRVALLGLLATHCPSEAPVARVATVARAKRKS AS* | 359 |

TABLE 6-continued

Amino acid sequences of exemplary gvpA/B, gvpF, gvpF/L, gvpG, gvpJ, gvpK, gvpL, gvpN, gvpV, gvpW, gvpR, gvpS, gvpT, and gvpU proteins

| Species, protein; | Amino acid sequence | SEQ ID NO.: |
|---|---|---|
| Thiocapsa rosea strain DSM 235 Ga0242571_11_gvpN | MSAKPLQDASEVSALNNDNVQPEASDTFVCTPSVEALAERASAYL QAGYPVHLAGPAGTGKTTLAFHAAAKRGRPVKLIHGNDELGLAD MVGQDNGYRRNTLVDNYIHSVVKTQEEVRTFWIDNRVTTACLNG ETLIYDEFNRSRPEVNNIFLSILGEGILNLPNRRHQGAGYLEVHPEF RVIFTSNPEEYAGTHKTQDALMDRMITMKIGHYDRETEIRVTRAK SGLPPSEVAIVVDIVRELRGQSVNHHRPTLRACIAIARIMADRRISA RSNNSFFRDICRDILDMDSAKVRRDGNALGESPVDDVVASISARAR RPKIVEPKGLHKEI* | 360 |
| Tolypothrix sp. PCC 7601_gvpN | MTNTENHKKRAVLRVRPGQFVVTPAIEKVAIRALRYLTSGFAIHLR GPAGTGKTTLAMHLANCLDRPIMLIFGDDEFKSSDLIGSESGYTHK KLLDNYIHNVLKVEDELKQNWVDSRLTLACREGLTLVYDEFNRS RPEVNNVLLSALEEKILTLPPSSNQPEYLHVPKFRAIFTSNPEEYC GVHSTQDALMDRLVTINMPEPDEQTQIEILTHKTGIHHEYAQLIAR LVKAFRSATGAEKTSGLRSCLMVAKVCAEHDILVTPENTDFREICA DVLFNRTNLSASDATTLFLELLNHVQVKPVEPVDDSDPYDVAEAE IVGAAEPQTDAIAEPVTLDESLLSDQPN* | 361 |
| Trichodesmium erythraeum IMS101_gvpN1 | MTTVLNVSPDRFVSTPGVERVTQRASRYLESGYSVHLRGPAGVGK TTLALHLAHLRQQPIFLMIGDDEFKTSDLIGNKSGYTRKKLVDNYI HTVLKVEDELRDNWIDSRLTLACKEGFTLIYDEFNRSRPEVNNVLL SVLEEKMLVLPPSQNQSEYIQVHPQFRVILTSNSEEWTGVHATQDA LLDRVVTIGMEQPDISTEQNIVIQKTGINPLKAEVIIKLVRSVRQRV DKEDLGSLRSALMISKVCHDHDIPLDGKDSSFSDLCADILISRPNLP RQEALQQLDEVLEEFFPADQPSSSDVGLEKEGSL* | 362 |
| Trichodesmium erythraeum IMS101_gvpN2 | MTTVLNVSPDRFVSTPSVERVTQRASRYLESGYSVHLRGPAGVGK TTLALHLAHLRQQPIFLMIGDDEFKTSDLIGNKSGYTRKKLVDNYI HTVLKVEDELKHNWIDSRLTLACKEGFTLIYDEFNRSRPEVNNVLL SVLEEKMLVLPPSQNQSEYIQVHPQFRVILTSNSEEWTGVHATQDA LLDRVVTIGMGQPDISTEQNIIIQKTGINPLKAEVIIKLVRSVRERLE TEDLGSLRSALMISKVCHDHDIPLGGKDSNFSDLCADILISRANLPR QEALKQLDEVLEELFPADQLSISDIGLKKEGSL* | 363 |
| gvpV | | |
| Anabaena-flos-aquae_gvpV | MIKNIQVFFMKTISNRSISRAKISTMPRPKSDASSQLDLYKMVTEK QRIQRDMYSIKERMGLLQQRLDILNQQIEATEKTIHKLRQPHSNTA QNIVRSNIFVESNNYQTFEVEY* | 364 |
| Aphanizomenon flos-aquae NIES-81_gvpV | MKSFRHRSIIRAKISTMPRHISEASSQLELYKMVAEKQRISRELSSIK ERMATLQKRLDSLNNEIDNTEKTIHKLRQPHSSTAQNIVRSKNVVE SNNYQTFEIEY* | 365 |
| Arthrospira platensis NIES-39_gvpV | MRYKYHRQIQPKLSAIPRQKSQANLYRNSYLLAVEKKRLTEELEV LQSRSHIIEQRLALIEDQLGELEKDVTQLSVPPSPKPQNNLPVNNPE PPPQSNPTNSSHINTFMVDY* | 473 |
| Burkholderia thailandensis sp. Bp5365 strain MSMB43_gvpV | MPIPKKGLHDIRFRHAPGATPLPVHSMYMRISCIEMEKSRRTIERRA AQRRIAAVDSRVADLEREKARLYAAIDNEAPQAGDIRGSFRIRY* | 366 |
| Desulfobacterium vacuolatum_DSM 3385_gvpV | MLKNRNRSIKGVQNIKTHAGKVDHVSHPHMAYMRISCLEMEKAR KNKEKSGAQKRIDMINQRLMEIEKEKAHIQRILGDTSIALESSNVD HDSEIKGGFKIKY* | 367 |
| Desulfomonile tiedjei DSM 6799_gvpV | MNIRMKGNSRGLRDIRTHSGKVDRVGLPYMAYMSISCLEMEKAR REKERLSALTRIKNIEQRIREIEAEKDLLLKGVGERTRTDLQKASTP RDQSAQCKGGFKIRY* | 368 |
| Legionella drancourtii LLAP12_gvpV | MMPALVKGLRNIKTMSNRLDKVQSPHEAFISAAALHREKQRHLQ ELAILRNRLDEINLRLEQINEQQNQVAEAFDISPPRAVKSALRTGIQ SKTGSTSHGFKIKY* | 369 |
| Microcystis aeruginosa NIES-843_gvpV | MTTTRPPRPIRSKISTMPRKQSEADHQLELYKLITEKQRIQEKLEM MERQIQQLKNRLTFVTEQIETTEQSIQNLRTANPPSVAKKPDSPKT VAHSSNNSSNFQTFYLEY* | 370 |
| Nostoc punctiforme ATCC 29133_gvpV | MHRTPNRRQIQAKLSTMPPQRSQATVYLNAYKMMLEKERLEEEL EKLEARRHQIQQRLAILNSQTIPEENMTHQQANTDLENNTPKFNTL TLEY* | 371 |

TABLE 6-continued

Amino acid sequences of exemplary gvpA/B, gvpF, gvpF/L, gvpG, gvpJ, gvpK, gvpL, gvpN, gvpV, gvpW, gvpR, gvpS, gvpT, and gvpU proteins

| Species, protein; | Amino acid sequence | SEQ ID NO.: |
|---|---|---|
| Nostoc sp. PCC 7120_gvpV | MLSIIQVFPMTKVRNRGIIRPKITTMPRNKSEASSQLELYKLVTEQQ RIKQELAFIEQRTVLLKQRLSTLKTQIEGTERSINHLRHSELKYSRIA LPKIFSETNNYQAFDIEY* | 372 |
| Planktothrix agardhii str. 7805_gvpV | MRPFRSQPPILPKISTMPRQKTEATLYRSLYQLAVEKKRLQEELESL GQRFETVTQRLQQIETQIQGLETDVKQIAPPKPPETKPNQPSTPTPT KAEPGSVSTFTLDY* | 373 |
| Psychromonas ingrahamii 37_gvpV1 | MTAAKRKTLRGLADIRTISSCGTSGQEAYQMYLKRGVLEMEKLR RQKEKNSALERVTNINRRLMAIDTDIDFLCQSLKVIEKRTNQENSIV EKSVSRGFKLRY* | 374 |
| Psychromonas ingrahamii 37_gvpV2 | MIFSKKKNALRGLADIRTLSGCGTSGQEAYQMYLKRGVLEMEKL RRQKEKNSALERVRNINYRLMAIDADIDFLCQSLKVIEERTNKENS ISNESVTYKKGFKLRY* | 375 |
| Serratia sp. ATCC 39006_gvpV | MAISTRPLRTLSDIKTHSGRVSGEHQTYRDYFQIGALELERWRRTR EREAASSRIASIDERIADIDKEKAALLADATAASAVAENNDKSEAA EKKKKSSGLRIKY* | 376 |
| Thiocapsa rosea strain DSM 235 Ga0242571_11_gvpV | MSKFTQPSRSVRDIKTLAGMADDVRAPHKMYMRLFALETERHRR LQERASAMLRVDNIDARCAEIAEEMEQLLQILGVEAVAPGGPPAN ARPGSGRVPTQPHRGRGKGTGAGRQTTSGETSVGEAVKIRY* | 377 |
| gvpW | | |
| Anabaena-flos-aquae_gvpW | MELENLYTYAFLEIPSSPLILPQGAANQVVLINGTELAAIVEPGIFLE SFQNNDEKIIQMALSHDRVICELFQQITVLPLRFGTYFTSTNNLLNH LKSHEKEYQNKLEKINGKNEFTLKLIPRMIEEIVPSEGGGKDYFLA KKQRYQNQNNFSIAQAAEKQNLIDLITKVNQLPVVVQEQEEQIQIY LLVSCQDKTLLLEQFLTWQKACPRWDLLLGDCLPPYHFI* | 378 |
| Aphanizomenon flos-aquae NIES-81_gvpW | MELENLYTYAFLKTPSFSLHLPQGSTTSVIQIDGNGLSAIVEPGISLD SFQDDDEKIVQMAIEHDRVICDIFRQITVLPLRFGTYFANTDNLLTH LESYGQEYLDKLEKINCKTEFILKLIPRMITEESPVLESGRHYFLAK KQHYQRQKNFILAQASEKEILINFISKINQIPVIIQEQEEEVRIYLLVN YQDKTLLLEQFLTWQQTCPRWDLFLGEGIPPYHFI* | 379 |
| Arthrospira platensis NIES-39_gvpW | MYVYAFIKSQSISWKSVQGIYEPVVLLEAGALAAVVEPNLQAENL SADNEEELMRAVLTHDRIVCQIFEETTVLPVRFGTCFDSEARLCEH LTTEGDRYFRQLEKLTGRAEYLLEAIPQPFNQEKPSSDTTAPPTKG RDYFLQKKRLHQQRLNFEQQQEQQWQDFINAIASKYPIVQGKATE DAERIYLLIPRSQEVALVEWVAQQQQNIDLWEFSLGNAVPAYHFL * | 380 |
| Dolichospermum circinale_gvpW | MKLENFYTYAFLEIPRFPLVLPQGAASQVILINGSGMSAIVEPGISLE SFQNNDEKIIQMALSHDRVICELFQQVTVLPLRFGTCFTSTNNLLN YLELHRQEYQEKLEKINGKIEFTLKLIPQTMEEPAPLERGGRDYFL AKKQRYQDQNNFRIAQAAEKQNLIDSISKVNQLPFVIQEKEEEVNI YLLVKSEDKTLLLEQFLNWQKACPRWDLLLGEPLPPYHFI | 381 |
| Microcystis aeruginosa NIES-843_gvpW | MKLYNLYTYAFLKTPIESLKLPVGMANPLLLITGGELSAVVEPEVG LDTLQNDDERLIQSVLCHDRVICQLFQQTTILPLRFGTSFLEAENLL THLCSHGQEYQEKIEELEGKGEYLLKCIPRKPEEPVLFSESKGRQYF LAKKQLYEAQQDFYTLQGSEWQNLVNLITQSYPSTRIITAPGTESRI YLLVNLQEEPLLIEQVLHWQKACPRWELQLGQVSPPYHFT* | 382 |
| Nostoc punctiforme ATCC 29133_gvpW | MSIYAYALLVPTASPLVLPLGMERNTELVYSSGLAALVEPEISLEAI QATDERLLQAVLNHDHVIRELFQQTPLLPLRFGRGFTSVEKLLNHL ENHQEQYLETLTQLADKVEYSVKVTACSLLDDSDTIDARGKAYLL AKKQRYQTQQAFQAQQCEQWELLNELILKTYTNVICETRQSDVR QIHFLAQRNDSTLSTQLFSLWQVQCSHWQLALSEPLPPYHFLKNTL I* | 383 |
| Nostoc sp. PCC 7120_gvpW | MRSPNFYTYAFLNTPDIPLRLPSGNLGQLLLIHGHKLSAVVEPGISL ESSQNNDEEVIKMVLAHDRVICELSQQTTVLPLRFGTYFNSEETLL NHIESHAQEYQKKLDHIQGKTEYTLKLIPRKFEELAKVSGGNGRD YFLAKKLHYEHQKNFIGDQNREKNHLINLIMDVYRSSAIIQDYVEE VRLHLLVDRHDKTLLFKQVLTLQEKCPHWNLILGEPLPPYHFV* | 384 |

TABLE 6-continued

Amino acid sequences of exemplary gvpA/B, gvpF, gvpF/L, gvpG, gvpJ, gvpK, gvpL, gvpN, gvpV, gvpW, gvpR, gvpS, gvpT, and gvpU proteins

| Species, protein; | Amino acid sequence | SEQ ID NO.: |
|---|---|---|
| gvpR | | |
| Bacillus-megaterium_gvpR | MEIKKIMQAVNDFFGEHVAPPHKITSVEATEDEGWRVIVEVIEERE YMKKYAKDEMLGTYECFVNKEKEVISFKRLDVRYRSAIGIEA* | 385 |
| gvpS | | |
| Bacillus-megaterium_gvpS | MSLKQSMENKDIALIDILDVILDKGVAIKGDLIISIAGVDLVYLDLR VLISSVETLVQAKEGNHKPITSEQFDKQKEELMDATGQPSKWTNP LGS* | 386 |
| Rhodococcus hoagii 103S_gvpS | MSATPDRRIALVDLLDRVLGGGVVVAGEITLSIADVDMVHISLRTL VSSVSALTRPPDEKPENDG* | 387 |
| gvpT | | |
| Bacillus-megaterium_gvpT | MATETKLDNTQAENKENKNAENGSKEKNGSKASKTTSSGPIKRA VAGGIIGATIGYVSTPENRKSLLDRIDTDELKSKASDLGTKVKEKS KSSVASLKTSAGSLFKKDKDKSKDDEENVNSSSSETEDDNVQEYD ELKEENQTLQDRLSQLEEKMNMLVELSLNKNQDEEAEDTDSDEEE NDENDENDENEQDDENEEETSKPRKKDKKEAEEEESESDEDSEEE EEDSRSNKKNKKVKTEEEDEDESEEEKKEAKPKKSTAKKSKNTKA KKNTDEEDDEATSLSSEDDTTA* | 388 |
| gvpU | | |
| Bacillus-megaterium_gvpU | MSTGPSFSTKDNTLEYFVKASNKHGFSLDISLNVNGAVISGTMISA KEYFDYLSETFEEGSEVAQALSEQFSLASEASESNGEAEAHFIHLK NTKIYCGDSKSTPSKGKIFWRGKIAEVDGFFLGKISDAKSTSKKSS* | 389 |

TABLE 7

Protein sequences of gvpC from exemplary species:

| Species | UniProt ID No. | Amino acid Sequence | SEQ ID NO: |
|---|---|---|---|
| Anabaena flos-aquae | P09413 | MISLMAKIRQEHQSIAEKVAELSLETREFLSVTTAKRQEQAEK QAQELQAFYKDLQETSQQFLSETAQARIAQAEKQAQELLAFH KELQETSQQFLSATAQARIAQAEKQAQELLAFYQEVRETSQQ FLSATAQARIAQAEKQAQELLAFHKELQETSQQFLSATADAR TAQAKEQKESLLKFRQDLFVSIFG | 390 |
| Halobacterium salinarum | P24574 | MSVTDKRDEMSTARDKFAESQQEFESYADEFAADITAKQDD VSDLVDAITDFQAEMTNTTDAFHTYGDEFAAEVDHLRADID AQRDVIREMQDAFEAYADIFATDIADKQDIGNLLAAIEALRTE MNSTHGAFEAYADDFAADVAALRDISDLVAAIDDFQEEFIAV QDAFDNYAGDFDAEIDQLHAAIADQHDSFDATADAFAEYRD EFYRIEVEALLEAINDFQQDIGDFRAEFETTEDAFVAFARDFY GHEITAEEGAAEAEAEPVEADADVEAEAEVSPDEAGGESAGT EEEETEPAEVETAAPEVEGSPADTADEAEDTEAEEETEEEAPE DMVQCRVCGEYYQAITEPHLQTHDMTIQEYRDEYGEDVPLR PDDKT | 391 |
| Halobacterium mediterranei | Q02228 | MSVKDKREKMTATREEFAEVQQAFAAYADEFAADVDDKRD VSELVDGIDTLRTEMNSTNDAFRAYSEEFAADVEHPHTSVAD RRDAFDAYADIFATDVAEMQDVSDLLAAIDDLRAEMDETHE AFDAYADAFVTDVATLRDVSDLLTAISELQSEFVSVQGEFNG YASEFGADIDQFHAVVAEKRDGHKDVADAFLQYREEFHGVE VQSLLDNIAAFQREMGDYRKAFETTEEAFASFARDFYGQGA APMATPLNNAAETAVTGTETEVDIPPIEDSVEPDGEDEDSKAD DVEAEAEVETVEMEFGAEMDTEADEDVQSESVREDDQFLDD ETPEDMVQCLVCGEYYQAITEPHLQTHDMTIKKYREEYGED VPLRPDDKA | 392 |
| Microchaete diplosiphon | P08041 | MTPLMIRIRQEHRGIAEEVTQLFKDTQEFLSVTTAQRQAQAK EQAENLHQFHKDLEKDTEEFLTDTAKERMAKAKQQAEDLFQ FHKEMAENTQEFLSETAKERMAQAEQARQLREFHQNLEQT TNEFLADTAKERMAQAEQKQQLHFRQDLFASIFGTF | 393 |

TABLE 7-continued

Protein sequences of gvpC from exemplary species:

| Species | UniProt ID No. | Amino acid Sequence | SEQ ID NO: |
|---|---|---|---|
| Nostoc sp. | Q8YUS9 | MTALMVRIRQEHRSIAEEVTQLFRETHEFLSATTAHRQEQAK QQAQQLHQFHQNLEQTTHEFLTETTTQRVAQAEAQANFLHK FHQNLEQTTQEFLAETAKNRTEQAKAQSQYLQQFRKDLFASI FGTF | 394 |

TABLE 8

Amino acid sequences of exemplary GVS and GVA proteins from B. megaterium.

| GVA Protein | Amino acid sequence | SEQ ID NO.: |
|---|---|---|
| gvpB | MSIQKSTNSSSLAEVIDRILDKGIVIDAFARVSVVGIEILTIEARVVIASVDTW LRYAEAVGLLRDDVEENGLPERSNSSEGQPRFSI | 395 |
| gvpR | MEIKKIMQAVNDFFGEHVAPPHKITSVEATEDEGWRVIVEVIEEREYMKKYAKD EMLGTYECFVNKEKEVISFKRLDVRYRSAIGIEA | 396 |
| gvpN | MTVLTDKRKKGSGAFIQDDETKEVLSRALSYLKSGYSIHFTGPAGGGKTSLARA LAKKRKRPVMLMHGNHELNNKDLIGDFTGYTSKKVIDQYVRSVYKKDEQVSE NWQDGRLLEAVKNGYTLIYDEFTRSKPATNNIFLSILEEGVLPLYGVKMTDPFVR VHPDFRVIFTSNPAEYAGVYDTQDALLDRLITMFIDYKDIDRETAILTEKTDVEE DEARTIVTLVANVRNRSGDENSSGLSLRASLMIATLATQQDIPIDGSDEDFQTLCI DILHHPLTKCLDEENAKSKAEKIILEECKNIDTEEK | 397 |
| gvpF | MSETNETGIYIFSAIQTDKDEEFGAVEVEGTKAETFLIRYKDAAMVAAEVPMKIY HPNRQNLLMHQNAVAAIMDKNDTVIPISFGNVFKSKEDVKVLLENLYPQFEKLF PAIKGKIEVGLKVIGKKEWLEKKVNENPELEKVSASVKGKSEAAGYYERIQLGG MAQKMFTSLQKEVKTDVFSPLEEAAEAAKANEPTGETMLLNASFLINREDEAKF DEKVNEAHENWKDKADFHYSGPWPAYNFVNIRLKVEEK | 398 |
| gvpG | MLHKLVTAPINLVVKIGEKVQEEADKQLYDLPTIQQKLIQLQMMFELGEIPEEAF QEKEDELLMRYEIAKRREIEQWEELTQKRNEES | 399 |
| gvpL | MGELLYLYGLIPTKEAAAIEPFPSYKGFDGEHSLYPIAFDQVTAVVSKLDADTYS EKVIQEKMEQDMSWLQEKAFHHHETVAALYEEFTIIPLKFCTIYKGEESLQAAIEI NKEKIENSLTLLQGNEEWNVKIYCDDTELKKGISETNESVKAKKQEISHLSPGRQ FFEKKKIDQLIEKELELHKNKVCEEIHDKLKELSLYDSVKKNWSKDVTGAAEQM AWNSVFLLPSLQITKFVNEIEELQQRLENKGWKFEVTGPWPPYHFSSFA | 400 |
| gvpS | MSLKQSMENKDIALIDILDVILDKGVAIKGDLIISIAGVDLVYLDLRVLISSVETLV QAKEGNHKPITSEQFDKQKEELMDATGQPSKWTNPLGS | 401 |
| gvpK | MQPVSQANGRIHLDPDQAEQGLAQLVMTVIELLRQIVERHAMRRVEGGTLTDE QIENLGIALMNLEEKMDELKEVFGLDAEDLNIDLGPLGSLL | 402 |
| gvpJ | MAVEHNMQSSTIVDVLEKILDKGVVIAGDITVGIADVELLTIKIRLIVASVDKAKE IGMDWWENDPYLSSKGANNKALEEENKMLHERLKTLEEKIETKR | 403 |
| gvpT | MATETKLDNTQAENKENKNAENGSKEKNGSKASKTTSSGPIKRAVAGGIIGATI GYVSTPENRKSLLDRIDTDELKSKASDLGTKVKEKSKSSVASLKTSAGSLFKKDK DKSKDDEENVNSSSSETEDDNVQEYDELKEENQTLQDRLSQLEEKMNMLVELS LNKNQDEEAEDTDSDEEENDENDENDENEQDDENEEETSKPRKKDKKEAEEEE SESDEDSEEEEEDSRSNKKNKKVKTEEEDEDESEEEKKEAKPKKSTAKKSKNTK AKKNTDEEDDEATSLSSEDDTTA | 404 |
| gvpU | MSTGPSFSTKDNTLEYFVKASNKHGFSLDISLNVNGAVISGTMISAKEYFDYLSE TFEEGSEVAQALSEQFSLASEASESNGEAEAHFIHLKNTKIYCGDSKSTPSKGKIF WRGKIAEVDGFFLGKISDAKSTSKKSS | 405 |

TABLE 9

Amino acid sequences of exemplary GVS and GVA proteins from *Serratia* sp..

| GVA Protein | Amino acid sequence | SEQ ID NO.: |
|---|---|---|
| gvpA1 | MAKVQKSTDSSSLAEVVDRILDKGIVIDAWVKVSLVGIELLSIEARVVIASVETY LKYAEAIGLTASAATPA | 406 |
| gvpA2 | MPVNKQYQDEQQQVSLCEALDRVLNKGVVIVADITISVANIDLIYLSLQALVSSV EAKNRLPGRE | 407 |
| gvpA3 | MPVNKQYQDEQQQVSLCEALDRVLNKGVVIVADITISVANIDLIYLSLQALVSSV EAKNRLPGRE | 408 |
| gvpC | MGCLTDGMAQLRKNIDDSHESRIAQQNARVSSVSAQIAGFSTTRARNAAQDAR ARATFVADNVRGVNRMLSDFCHTREVMSRQQSEERATFVTDMSKKTLALLDGF NAERKSMAERCAKERADFIANVANDVAAFLSASEKDRMAAHAVFFGMTLAKK KTSLAV | 409 |
| gvpN | MIKQNTVSQYTVDDDLVVPEASEHFVATSYVNDIIERALVYLRAGYPVHFAGPS GIGKTTLAFHLAALWGRPVTMLQGNEEFVSSDLTGKDIGYRKSSLVDNYIHSVL KTEEQMNRMWVDNRLTTACRNGDMLIYDEFNRSKAETNNVLLSVLSEGILNLP GLRGVGEGYLDVHPEFRAIFTSNPEEYAGTHKTQDALMDRMITINIGLVDRDTEL QILHARSELELKEAAYIVDIIRELRGNEHETKHGLRAGIAIAHILHQQGIKPRYGD KLFHAICYDVLSMDAAKIQHAGRSIYREMVDGVIRKICPPIGSDTVKASTQKIKA VE | 410 |
| gvpV | MAISTRPLRTLSDIKTHSGRVSGEHQTYRDYFQIGALELERWRRTREREAASSRI ASIDERIADIDKEKAALLADATAASAVAENNDKSEAAEKKKKSSGLRIKY | 411 |
| gvpF1 | MMSIDKSRNHRAKVLYALCVSDDSTPNYKIRGLEAAPVYSIDQDGLRAVVSDTL STRLRPERRNITAHQAVLHKLTEEGTVLPMRFGVIARNAEAVKNLLVANQDTIR EHFERLDGCVEMGLRVSWDVTNIYEYFVATYPVLSETRDEIWNGNSNANNHRE EKIRLGNLYESLRSGDRKESTEKVKEVLLDYCEEIIENPVKKEKDVMNLACLVA RERMDEFAKGVFEASKLFDNVYLFDYTGPWAPHNFVTLDLHAPTAKKKTLTRA GTLSD | 412 |
| gvpF2 | MTMNTEAQTEQAIYLYGLTLPDLAAPPILGVDNQHPINTHQCAGLNAVISPVALS DFTGEKGEDNVQNVTWLTPRICRHAQIIDSLMAQGPVYPLPFGTLFSSQNALEQE MKSRATDVFVSLRRITGCQEWALEATLDRKQAVDVLFTEGLDSGRFCLPEAIGR RHLEEQKLRRRLTTELSDWLAHALTAMQNELHPLVRDFRSRRLLDDKILHWAY LLPVEDVAAFQQQVADIVERYEAYGFSFRVTGPWAAYSFCQPDES | 413 |
| gvpF3 | MSLLLYGIVAEDTQLALEPDGSPHAGEEPMQLVKAATLAALVKPCEADVSREPA AALAFAGQQIMHVHQQTTIIPIRYGCVLADEDAVTQHLLNHEAHYQTQLVELENC DEMGIRLSLASAEDNAVTTPQASGLDYLRSRKLAYAVPEHAERQAALLNNAFT GLYRRHCAEISMFNGQRTYLLSYLVPRTGLQAFRDQFNTLANNMTDIGVISGPW PPYNFAS | 414 |
| gvpG | MLLIDDILFSPVKGVMWIFRQIHELAEDELAGEADRIRESLTDLYMLLETGQITED EFEQQEAVLLDRLDALDEEDDMLGDEPGDDEDDEYEEDDDEEDDDEEDDDDE DDDDEDDDDEEDDDDDEDDDDEDEPEGTTK | 415 |
| gvpW | MKPAIYPKFLLESPLKLVFFGGKGGVGKSTCATSTALRLAQEQPQHHFLLVSTDP AHSLQNILSDLVLPKNLDVRELNAAASLHEFKSQHEGVLKEIAYRGTVLDQNDV QGLMDTALPGMDELAAYLEIAEWIQKDTYYRIIIDTAPTGHTLRLLEMPDLIYRW LTALDTLLAKQRYIRKRFAGDNRLDHLDHFLLDMNDSLKAMHELVTDSTRCCF VLVMLAEAMSVEESIDLAGALNQQRVFLSDLVVNRLFPENDCPTCCVERNRQM LALQNGYQRLPGHVFWTLPLLAIEPRGALLHEFWSGVRLLDENEVMATTCHHQ LPLRVESSISLPASTFRLLIFAGKGGVGKTTLACATALRLNSEYPELRILLFSADPA HSLSDCLGVTLQQQPISVLVNIDAQEINAQADFDKIRQGYRAELEAFLLDTPNL DITFDREVLEHLLDLAPPGLDEIMALTAIMDHLDSGRYDMVIVDGAPSGHLLRLL ELPELIRDWLKQFFSLLLKYRKVMRFPHLSERLVQLSRELKNLRALLQDTKQTG LYAVTVPTHLALEKTYEMTCALQRLGLTANALFINQITPPSDCTLCQAITSRESLE LKCADEMFPSQPHAQIFRQTEPTGLSKLKTLGSALFL | 416 |
| gvpK | MTTNQLSHHSPVFGPTSPAIQRPITEANRHKIDIDGERVRDGLAQLVLTLVKLLH ELLERQAIRRMDSGSLSDEEVERLGLALMRQAEELTHLCDVFGFKDDDLNLDLG PLGRLL | 417 |
| gvpX | MVNTTNDINAATRGLLLRMGNAWFEQDELRQAVDIYLKIIEQYPDSKESKTAQT ALLTISQRYERDGLFRLSLDILERVGEITPTSI | 418 |
| gvpY | MRALIHFPIIHSPKDLGTLSEAASHLRTETQTRAYLAAVEGFWTMITTTIEGLDLD YTHLKLYQDGLPVCGKENEIVTDVANAGSQNYKLLLTLQHKGAILMGTESPELL LQERDLMTQLLQSTEQTEASLETAKTLLNRRDDYIAQRIDETLQDGEMAILFLGL MHNIEAKLPADIVFIQPLGKPPGGESI | 419 |

TABLE 9-continued

Amino acid sequences of exemplary GVS and GVA proteins from *Serratia* sp..

| GVA Protein | Amino acid sequence | SEQ ID NO.: |
|---|---|---|
| gvpH | MTGNVEGILRGLGDLVEKLVETGEQIKRSGAFDIDTNDGKNAKAVYGFSIKMGL DGNQENRVEPFGNIRRDEQTGEATVQEVSEPLVDVIEESDHVLVLAEMPGVADE DVQVELNGDILTLHSERGSKKYHKEIVLPCSFDDKAMERSCRNGILEVKLGK | 420 |
| gvpZ | MSEELKLKVAEALPKDAGRGYARLDPADMARLNLAVGDIVQLTSKKGTGIAKL MPTYPDMRNKGIVQLDGLTRRNTSLSLDEKVQIEPASCKHATQIVLIPTTITPNQR DLDYIGSLLDGLPVQKGDLLRAHLFGSRSADFKVESTIPDGAVLIDPTTTLVIGKS NAVGNSSHSTQRLSYEDVGGLKNQVRRIREMIELPLRYPEVFERLGIDAPKGVLL SGPPGCGKTLIARIIAQETDAQFFTISGPEIVHKFYGESEAHLRKIFEEAGRKGPSII FLDEIDSIAPHRDKVVGDVEKRIVAQLLALMDGLKNRGKVIVIAATNLPNAIDPA LRRPGRFDREISIPIPDREGRREIIEIHSTGMPLNADVDLNVLADITHGFVGADLEA LCREAAMSALRRLLPEIDFSSAELPYDRLAELTVMMDDFRAALCEVSPSAIRELF VDIPDVRWEDVGGLDDVRRRLIESVEWPIKYPELYEQAGVKPPKGLLLAGPPGV GKTLIAKAVANESGVNVISVKGPALMSRYVGDSEKGVRELFLKARQAAPCIIFLD EVDSVIPARNEGAIDSHVAERVLSQFLSEMDGLEELKGVFVMGATNRADLIDPA MLRPGRFDEIIELGLPDEDARRQILAVHLRNKPLGDNIHADDLAERCDGASGAEL AAVCNRAALAALRRAIQQSEEAVLSPSTVGETPVALTVRIEQHDFAEVIAEMFG DDA | 421 |

TABLE 10

Amino Acid Sequences of GV proteins from *Anabaena flos-aquae*

| gvp gene | Sequence | SEQ ID NO: |
|---|---|---|
| gvpA | MAVEKTNSSSSLAEVIDRILDKGIVIDAWVRVSLVGIELLAIEARIVIASVETYLK YAEAVGLTQSAAVPA | 422 |
| gvpC | MISLMAKIRQEHQSIAEKVAELSLETREFLSVTTAKRQEQAEKQAQELQAFYKD LQETSQQFLSETAQARIAQAEKQAQELLAFHKELQETSQQFLSATAQARIAQAEK QAQELAFYQEVRETSQQFLSATAQARIAQAEKQAQELLAFHKELQETSQQFLS ATADARTAQAKEQKESLLKFRQDLFVSIFG | 423 |
| gvpN | MTTTKVNHKRAVLRLRPGQFVVTPAIERVAIRALRYLKSGFPVHLRGPAGTGKT TLAMHLANCLDRPVMLLFGDDQFKSSDLIGSESGYTHKKVLDNYIHSVVKLEDE FKQNWVDSRLTLACREGFTLVYDEFNRSRPEVNNVLLSALEEKILSLPPSSNQPE YLSVNPQFRVIFTSNPEEYAGVHSTQDALMDRLVTISMPEPDEITQTEILIQKTNID RESANFIVRLVKSFRLATGAEKTSGLRSCLMIAKVCADNNIPVTTESLDFPDIAIDI LFNRSHLSMSESTNIFLELLDKFSAEELEILNNRVTGDNDFLIDNSQFVSQQLAGQ PN | 424 |
| gvpJ | MLPTRPQTNSSRTINTSTQGSTLADILERVLDKGIVIAGDISISIASTELVHIRIRLLI SSVDKAKEMGINWWESDPYLSTKAQRLVEENQQLQHRLESLEAKLNSLTSSSVK EEIPLAADVKDDLYQTSAKIPSPVDTPIEVLDFQAQSSGGTPPYVNTSMEILDFQA QTSAESSSPVGSTVEILDFQAQTSEESSSPVVSTVEILDFQAQTSEESSSPVGSTVEI LDFQAQTSEEIPSSVDPAIDV | 425 |
| gvpK | MVCTPAENFNNSLTIASKPKNEAGLAPLLLTVLELVRQLMEAQVIRRMEEDLLS EPDLERAADSLQKLEEQILHLCEMFEVDPADLNINLGEIGTLLPSSGSYYPGQPSS RPSVLELLDRLLNTGIVVDGEIDLGIAQIDLIHAKLRLVLTSKPI | 426 |
| gvpF | MSIPLYLYGIFPNTIPETLELEGLDKQPVHSQVVDEFCFLYSEARQEKYLASRRNL LTHEKVLEQTMHAGFRVLLPLRFGLVVKDWETIMSQLINPHKDQLNQLFQKLA GKREVSIKIFWDAKAELQTMMESHQDLKQQRDNMEGKKLSMEEVIQIGQLIEIN LLARKQAVIEVFSQELNPFAQEIVVSDPMTEEMIYNAAFLIPWESESEFSERVEVI DQKFGDRLRIRYNNFTAPYTFAQLDS | 427 |
| gvpG | MLTKLLLLPIMGPLNGVVWIAEQIQERTNTEFDAQENLHKQLLSLQLSFDIGEIGE EEFEIQQEEEILLKIQALEEEARLELEAEQEEARLELEAEQEDFEYPPQFTAEVNKD QHLVLLP | 428 |
| gvpV | MIKNIQVFFMKTISNRSISRAKISTMPRPKSDASSQLDLYKMVTEKQRIQRDMYSI KERMGLLQQRLDILNQQIEATEKTIHKLRQPHSNTAQNIVRSNIFVESNNYQTFE VEY | 429 |

TABLE 10-continued

Amino Acid Sequences of GV proteins from Anabaena flos-aquae

| gvp gene | Sequence | SEQ ID NO: |
|---|---|---|
| gvpW | MELENLYTYAFLEIPSSPLILPQGAANQVVLINGTELAAIVEPGIFLESFQNNDEKII QMALSHDRVICELFQQITVLPLRFGTYFTSTNNLLNHLKSHEKEYQNKLEKINGK NEFTLKLIPRMIEEIVPSEGGGKDYFLAKKQRYQNQNNFSIAQAAEKQNLIDLITK VNQLPVVVQEQEEQIQIYLLVSCQDKTLLLEQFLTWQKACPKWDLLLGDCLPPY HFI | 430 |

Example 5: Identification of Alternative *B. megaterium* Gene Cluster Detectable by TEM in *E. coli*

The Gas Vesicle gene cluster of Table 8 above was tested to identify possible alternative clusters detectable by TEM.

Figure 7:
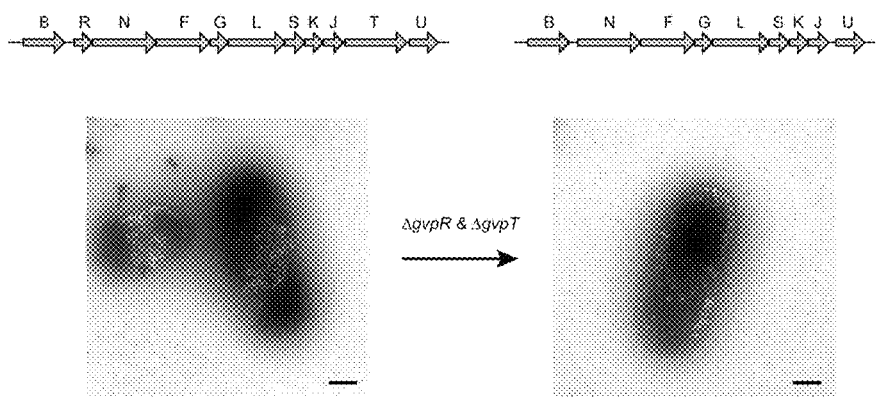
FIG. 7 illustrates the expression of an exemplary *B. megaterium* gene cluster for gas vesicle formation. In particular, FIG. 7 top panel shows a schematic representation of bacterial gas vesicle gene clusters used for heterologous expression of gas vesicles in *E. coli*.

In particular, the *B. megaterium* gene cluster can be expressed in *E. coli* Rosetta 2(DE3)pLysS cells using the two construct schematically illustrated in FIG. 7 top panel.

The formation of gas vesicles was detected through Transmission Electronic Microscopy (TEM) after expression of gas vesicles genes for 22 hours.

The results shown in FIG. 7 bottom panel indicate that gvpR and gvpT genes in the *B. megaterium* gene cluster are not necessary for gas vesicle formation.

Therefore, the following alternative GV cluster including 9 gvp gene sequences of *B. megaterium* genes shown in the following Table 11 and FIG. 12B was identified as detectable by TEM and ultrasound in mammalian cells (HEK293 and CHO-K1).

TABLE 11

Gvp genes of exemplary GV gene cluster from B. megaterium

| Gene | Sequence | Seq ID NO: |
|---|---|---|
| gvpB | ATGAGCATCCAGAAGTCCACCAACAGCAGC AGCCTGGCCGAAGTGATCGACCGGATCCTG GACAAGGGCATCGTGATCGACGCCTTCGCC AGAGTGTCCGTCGTGGGCATCGAGATCCTG ACCATCGAGGCCAGAGTCGTGATCGCCAGC GTGGACACCTGGCTGAGATATGCCGAAGCC GTGGGCCTGCTGCGGGACGACGTGGAAGAA AATGGCCTGCCCGAGCGGAGCAACAGCTCT GAGGGACAGCCCCGGTTCAGCATCTGA | 431 |
| gvpN | ATGACCGTGCTGACCGACAAGCGGAAGAAG GGCAGCGGCGCCTTCATCCAGGACGACGAG ACAAAAGAGGTGCTGAGCAGAGCCCTGAGC TACCTGAAGTCCGGCTACAGCATCCACTTC ACCGGACCTGCCGGCGGAGGCAAGACATCT CTGGCTAGAGCCCTGGCCAAGAAACGGAAG CGGCCCGTGATGCTGATGCACGGCAACCAC GAGCTGAACAACAAGGACCTGATCGGCGAT TTCACCGGCTACACCAGCAAGAAAGTGATC GACCAGTACGTGCGGAGCGTGTACAAGAAA GACGAACAGGTGTCCGAGAACTGGCAGGAC GGCAGACTGCTGGAAGCCGTGAAGAATGGC TACACCCTGATCTACGACGAGTTCACCAGA AGCAAGCCCGCTACCAACAACATCTTCCTG AGCATCCTGGAAGAGGGCGTGCTGCCCCTG TACGGCGTGAAGATGACCGACCCTTTCGTG CGCGTGCACCCCGACTTCAGAGTGATCTTC ACCAGCAACCCCGCCGAGTATGCCGGCGTG TACGATACCCAGGACGCCCTGCTGGACCGG CTGATCACCATGTTCATCGACTACAAGGAC ATCGACCGGGAAACCGCCATCCTGACCGAG AAAACCGACGTGGAAGAGGACGAGGCCCGA | 432 |
| | ACCATCGTGACCCTGGTGGCCAACGTGCGG AACAGAAGCGGCGACGAGAATAGCAGCGGC CTGAGCCTGAGAGCCAGCCTGATGATTGCC ACCCTGGCCACCCAGCAGGACATCCCTATC GATGGCAGCGACGAGGACTTCCAGACCCTG TGCATCGACATCCTGCACCACCCCCTGACC AAGTGCCTGGACGAGGAAAACGCCAAGAGC AAGGCCGAGAAGATCATTCTGGAAGAGTGC AAGAACATCGACACCGAGGAAAAGTGA | |
| gvpF | ATGAGCGAGACAAACGAGACAGGCATCTAC ATCTTCAGCGCCATCCAGACCGACAAGGAC GAGGAATTCGGCGCCGTGGAAGTGGAAGGG ACCAAGGCCGAGACATTCCTGATCCGGTAC AAGGACGCCGCCATGGTGGCCGCCGAAGTG CCCATGAAGATCTACCACCCCAACCGGCAG AACCTGCTGATGCACCAGAATGCCGTGGCC GCCATCATGGACAAGAACGACACCGTGATC CCCATCAGCTTCGGCAACGTGTTCAAGAGC AAAGAGGACGTGAAGGTGCTGCTGGAAAAC CTGTACCCCCAGTTCGAGAAGCTGTTCCCC GCCATCAAGGGAAAGATCGAAGTGGGCCTG AAAGTGATCGGCAAGAAAGAGTGGCTGGAA AAGAAAGTGAACGAGAACCCCGAGCTGGAA AAAGTGTCCGCCAGCGTGAAGGGCAAGAGC GAGGCCGCTGGCTACTACGAGAGAATCCAG CTGGGCGGCATGGCCCAGAAGATGTTCACC AGCCTGCAGAAAGAAGTGAAAACCGACGTG TTCAGCCCCCTGGAAGAAGCCGCCGAGGCC GCCAAAGCCAATGAGCCTACAGGCGAGACA ATGCTGCTGAACGCCAGCTTCCTGATCAAC AGAGAGGACGAGGCCAAGTTCGACGAAAAA GTGAATGAGGCCCACGAGAACTGGAAGGAT AAGGCCGACTTCCACTACAGCGGCCCCTGG CCCGCCTACAACTTCGTGAACATCCGGCTG AAGGTGGAAGAGAAGTGA | 433 |
| gvpG | ATGCTGCACAAGCTCGTGACCGCCCCCATC AACCTGGTCGTGAAGATCGGCGAGAAGGTG CAGGAAGAGGCCGACAAGCAGCTGTACGAC CTGCCCACCATCCAGCAGAAGCTGATCCAG CTGCAGATGATGTTCGAGCTGGGCGAGATC CCCGAGGAAGCTTCCAGGAAAAAGAGGAC GAGCTGCTGATGAGATACGAGATCGCCAAG CGGCGCGAGATCGAGCAGTGGGAGGAACTG ACCCAGAAGCGGAACGAGGAAAGCTGA | 434 |
| gvpL | ATGGGCGAGCTGCTGTACCTGTACGCCCTG ATCCCCACCAAAGAGGCCGCTGCCATCGAG CCCTTCCCATTCTACAAGGGCTTCGACGGC GAGCACAGCCTGTACCCTATCGCCTTCGAC CAAGTGACCGCCGTGGTGTTCAAGCTGGAC GCCGACACCTACAGCGAGAAAGTGATCCAG GAAAAGATGGAACAGGACATGAGCTGGCTG CAGGAAAAGGCCTTCCACCACCACGAGACA GTGGCCGCCCTGTACGAGGAATTCACCATC ATCCCCCTGAAGTTCTGCACCATCTATAAG GGCGAGGAATCCCTGCAGGCCGCCATCGAG | 435 |

TABLE 11-continued

Gvp genes of exemplary GV gene cluster from B. megaterium

| Gene | Sequence | Seq ID NO: |
|---|---|---|
|  | ATCAACAAAGAGAAGATCGAGAACTCCCTG ACCCTGCTGCAGGGCAACGAGGAATGGAAC GTGAAGATCTACTGCGACGACACCGAGCTG AAGAAGGGCATCAGCGAGACAAACGAGAGC GTGAAGGCCAAGAAGCAGGAAATCAGCCAC CTGAGCCCCGGCAGACAGTTCTTCGAGAAG AAGAAGATTGACCAGCTGATCGAGAAAGAG CTGGAACTGCACAAGAACAAAGTGTGCGAG GAAATCCACGACAAGCTGATTGAGCTGAGC CTGTACGACTCCGTGAAGAAGAACTGGTCC AAGGACGTGACCGGCGCTGCCGAACAGATG GCCTGGAACAGCGTGTTCCTGCTGCCCAGC CTGCAGATCACCAAGTTCGTGAACGAGATC GAGGAACTGCAGCAGCGGCTGGAAAACAAG GGCTGGAAGTTCGAAGTGACCGGCCCCTGG CCTCCCTACCACTTCAGCAGCTTTGCCTGA |  |
| gvpS | ATGAGCCTGAAGCAGAGCATGGAAAACAAG GATATCGCCCTGATCGACATCCTGGACGTG ATCCTGGACAAGGGCGTGGCCATCAAGGGC GACCTGATCATCTCTATCGCCGGCGTGGAC CTGGTGTACCTGGACCTGAGAGTGCTGATC TCCAGCGTGGAAACCTGGTGCAGGCCAAA GAGGGCAACCACAAGCCCATCACCAGCGAG CAGTTCGACAAGCAGAAAGAGGAACTGATG GACGCCACCGGCCAGCCCAGCAAGTGGACA AATCCTCTGGGCAGC | 436 |
| gvpK | ATGCAGCCCGTGTCCCAGGCCAACGGCAGA ATCCACCTGGATCCCGATCAGGCCGAACAG GGACTGGCCCAGCTCGTGATGACCGTGATC GAGCTGCTGCGGCAGATCGTGGAACGGCAC GCCATGAGAAGAGTGGAAGGCGGCACCCTG ACCGACGAGCAGATCGAGAATCTGGGAATC GCCCTGATGAACCTGGAAGAGAAGATGGAC GAGCTGAAAGAGGTGTTCGGACTGGACGCC | 437 |

TABLE 11-continued

Gvp genes of exemplary GV gene cluster from B. megaterium

| Gene | Sequence | Seq ID NO: |
|---|---|---|
|  | GAGGACCTGAACATCGACCTGGGCCCTCTG GGCAGCCTGCTGTGA |  |
| gvpJ | ATGGCCGTGGAACACAACATGCAGAGCAGC ACCATCGTGGACGTGCTGGAAAAGATCCTG GACAAGGGCGTCGTGATCGCCGGGGACATC ACAGTGGGAATCGCCGACGTGGAACTGCTG ACCATCAAGATCCGGCTGATCGTGGCCAGC GTGGACAAGGCCAAAGAAATCGGCATGGAT TGGTGGGAGAACGACCCCTACCTGAGCAGC AAGGGCGCCAACAACAAGGCCCTGGAAGAG GAAAACAAGATGCTGCACGAGCGGCTGAAA ACACTGGAAGAGAAGATCGAGACAAAGCGC TGA | 438 |
| gvpU | ATGAGCACCGGCCCCAGCTTCAGCACCAAG GACAACACCCTGGAATACTTCGTGAAGGCC AGCAACAAGCACGGCTTCAGCCTGGACATC AGCCTGAACGTGAACGGGGCCGTGATCAGC GGCACCATGATCAGCGCCAAAGAGTACTTC GACTACCTGAGCGAGACATTCGAAGAGGGC AGCGAGGTGGCCCAGGCCCTGTCTGAGCAG TTTAGCCTGGCCAGCGAGGCCTCCGAGTCT AATGGCGAAGCCGAGGCCCACTTCATCCAC CTGAAGAACACCAAGATCTACTGCGGCGAC AGCAAGAGCACCCCCAGCAAGGGCAAGATC TTCTGGCGCGGCAAGATCGCCGAGGTGGAC GGATTCTTCCTGGGAAAGATCAGCGACGCC AAGTCCACCAGCAAGAAGTCCAGCTGA | 439 |

Each gene is cloned in pCMVSport plasmid which contains CMV promoter upstream of each gene and SV40 polyadenylation tail downstream of each gene, as illustrated in FIG. 12B. The gene cassettes elements of the pCMVSport plasmid are reported in Table 11a below.

TABLE 11a

Additional elements of the GVP cassettes

| Element | Sequence | SEQ ID NO: |
|---|---|---|
| CMV enhancer/ CMV promoter | CGTTACATAACTTACGGTAAATGGCCCGCCTGGCTGACCGCCCAACGAC CCCCGCCCATTGACGTCAATAATGACGTATGTTCCCATAGTAACGCCAA TAGGGACTTTCCATTGACGTCAATGGGTGGAGTATTTACGGTAAACTGC CCACTTGGCAGTACATCAAGTGTATCATATGCCAAGTACGCCCCCTATT GACGTCAATGACGGTAAATGGCCCGCCTGGCATTATGCCCAGTACATGA CCTTATGGGACTTTCCTACTTGGCAGTACATCTACGTATTAGTCATCGCT ATTACCATGGTGATGCGGTTTTGGCAGTACATCAATGGGCGTGGATAGC GGTTTGACTCACGGGGATTTCCAAGTCTCCACCCCATTGACGTCAATGG GAGTTTGTTTTGGCACCAAAATCAACGGGACTTTCCAAAATGTCGTAAC AACTCCGCCCCATTGACGCAAATGGGCGGTAGGCGTGTACGGTGGGAG GTCTATATAAGCAGAGCT | 440 |
| SV40 polyadenylation tail | AACTTGTTTATTGCAGCTTATAATGGTTACAAATAAAGCAATAGCATCAC AAATTTCACAAATAAAGCATTTTTTTCACTGCATTCTAGTTGTGGTTTGTC CAAACTCATCAATGTATCTTATCATGTCTGGATC | 441 |

Example 6 Construction of a GVES Configured for Expression in Mammalian Cells

Using the genes of the exemplary *B. megaterium* cluster reported in Table 11 above, the development of a synthetic mammalian operon with the minimum number of genes required to produce gas vesicles was investigated.

For this, the Applicant turned to viral elements that have evolved to exploit the eukaryotic genetic machinery to allow for the expression of multiple genes from a single promoter (polycistronic gene expression).

The most common elements used the internal ribosomal entry sequence (IRES) and the 2A self-cleavage peptide [42]. Briefly, when placed between two genes the IRES region of the transcribed mRNA form a secondary structure that enables cap-independent ribosomal entry leading to co-translation of the downstream gene.

Alternatively, by placing the 2A self-cleavage peptide element between two genes, the resultant mRNA sequence causes a 'ribosomal skip' that releases the first protein and proceeds to translate the second protein. The 2A element has a smaller genetic footprint and higher co-expression efficiency for the downstream gene compared with IRES, however, its use results in n- and c-terminal modifications to the proteins.

To test if the gas vesicle genes could tolerate modifications due to the addition of element 2A, additional experiments were performed reported in the following Example 7.

Example 7: Identification of Tolerability *B. Megaterium* Gene Cluster Detectable by TEM To test if the gas vesicle genes could tolerate the N- and C-terminal 2A modifications, the genes of the exemplary *B. megaterium* gene cluster of Example 5 and Table 11 were modified.

Figure 8:
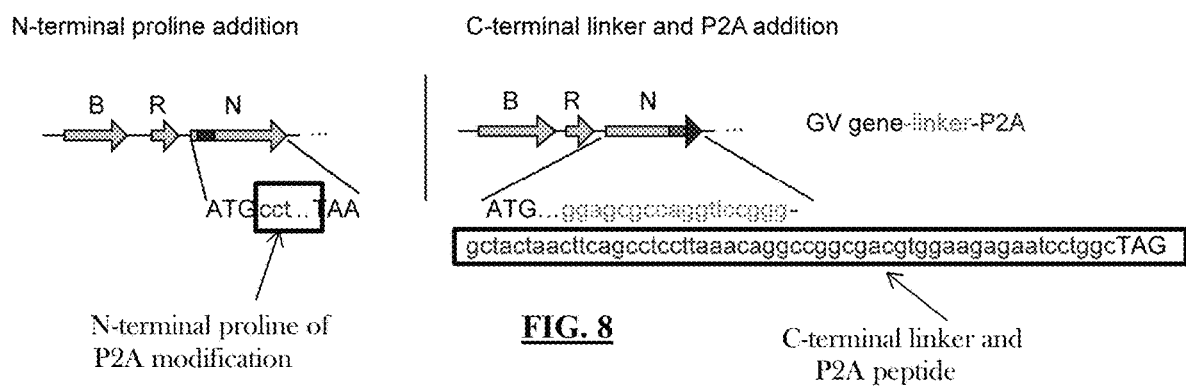
FIG. 8 shows a schematic illustration of an assay for tolerability of P2A peptide additions. In particular, FIG. 8 provides a schematic illustration of gas vesicle gene cluster with N-terminal modifications (left) or C-terminal modifications (right) of each gene (SEQ ID NO: 479 and 480) to test tolerability of P2A peptides, in a one-by-one settings in *E. coli*.

In particular, the n-terminal proline and c-terminal 24 amino acid (GAPGSGATNFSLLKQAG-DVEENPG) (SEQ ID NO: 442) modification were tested in *Escherichia coli* using the bacterial gas vesicle gene cluster, according to the approach schematically illustrated in FIG. 8.

All genes except for the structural protein gas vesicle protein B tolerated the n- and c-terminal 2A modifications) as shown by the results summarized in the following Table 12.

TABLE 12

| Gene | GVs after N-term addition? | GVs after C-term addition? |
|---|---|---|
| gvpB | — | No |
| gvpR | Yes | Yes |
| gvpN | Yes | Yes |
| gvpF | Yes | Yes |
| gvpG | Yes | Yes |
| gvpL | Yes | Yes |
| gvpS | Yes | Yes |
| gvpK | Yes | Yes |
| gvpJ | Yes | Yes |
| gvpT | Yes | Yes |
| gvpU | Yes | Yes |

In particular, the results of Table 12 above indicate tolerability of P2A peptide additions to *B. megaterium* gas vesicle genes. Each gene of the *B. megaterium* gene cluster was modified with an N-terminal proline after the start codon or with a linker and P2A peptide at the C-terminus, resulting in a total of 21 unique GV gene clusters as illustrated in FIG. 8. *E. coli* were transformed with each plasmid and gas vesicles were induced for expression for a total of 22 hours and assayed for the presence of gas vesicles using TEM. The table indicates whether gas vesicles were observed by TEM. Expression and TEM imaging performed as in [43].

Example 8: Engineering of a GVPC Construct

An exemplary polynucleotide construct was provided including all the genes of the GV gene cluster of *B. megaterium* reported in Table 11. A GVPC construct was therefore provided using the related GVA genes separated by a separation elements encoding peptide 2A.

The sequence of this exemplary GVPC construct in which the gvp genes are included in a pCMVSport backbone is reported in Table 13 below. gvp N, F, G, L, S, K, J, U and EmGFP are separated by GAPGSG-p2A sequence.

TABLE 13

Exemplary GVPC construct

| Construct | Sequence | SEQ ID NO: |
|---|---|---|
| CMV: gvp NFGLSKJU-EmGFP: polyA | CGTTACATAACTTACGGTAAATGGCCCGCCTGGCTGACCGCCCAACGACCC<br>CCGCCCATTGACGTCAATAATGACGTATGTTCCCATAGTAACGCCAATAGG<br>GACTTTCCATTGACGTCAATGGGTGGAGTATTTACGGTAAACTGCCCACTTG<br>GCAGTACATCAAGTGTATCATATGCCAAGTACGCCCCCTATTGACGTCAATG<br>ACGGTAAATGGCCCGCCTGGCATTATGCCCAGTACATGACCTTATGGGACTT<br>TCCTACTTGGCAGTACATCTACGTATTAGTCATCGCTATTACCATGGTGATG<br>CGGTTTTGGCAGTACATCAATGGGCGTGGATAGCGGTTTGACTCACGGGGA<br>TTTCCAAGTCTCCACCCCATTGACGTCAATGGGAGTTTGTTTTGGCACCAAA<br>ATCAACGGGACTTTCCAAAATGTCGTAACAACTCCGCCCCATTGACGCAAA<br>TGGGCGGTAGGCGTGTACGGTGGGAGGTCTATATAAGCAGAGCTCGTTTAG<br>TGAACCGTCAGATCGCCTGGAGACGCCATCCACGCTGTTTTGACCTCCATAG<br>AAGACACCGGGACCGATCCAGCCTCCGGACTCTAGCCTAGGCTTTTGCAAA<br>AAGCTATTTAGGTGACACTATAGAAGGTACGCCTGCAGGTACCGAGCTCGG<br>ATCCAGTACCCTTCACCATGACCGTGCTGACCGACAAGCGGAAGAAGGGCA<br>GCGGCGCCTTCATCCAGGACGACGAGACAAAAGAGGTGCTGAGCAGAGCC<br>CTGAGCTACCTGAAGTCCGGCTACAGCATCCACTTCACCGGACCTGCCGGC<br>GGAGGCAAGACATCTCTGGCTAGAGCCCTGGCCAAGAAACGGAAGCGGCC<br>CGTGATGCTGATGCACGGCAACCACGAGCTGAACAACAAGGACCTGATCGG<br>CGATTTCACCGGCTACACCAGCAAAAAGGTGATCGACCAGTACGTGCGGAG<br>CGTGTACAAGAAAGACGAACAGGTGTCCGAGAACTGGCAGGACGGCAGAC<br>TGCTGGAAGCCGTGAAGAATGGCTACACCCTGATCTACGACGAGTTCACCA | 443 |

TABLE 13-continued

Exemplary GVPC construct

| Construct | Sequence | SEQ ID NO: |
|---|---|---|
| | GAAGCAAGCCCGCTACCAACAACATCTTCCTGAGCATCCTTGAGGAGGGCG TGCTGCCCCTGTACGGCGTGAAGATGACCGACCCTTTCGTGCGCGTGCACCC CGACTTCAGAGTGATCTTTACCAGCAACCCCGCCGAGTATGCCGGCGTGTA CGATACCCAGGACGCCCTGCTGGACCGGCTGATCACCATGTTCATCGACTA CAAGGACATCGACCGGGAAACCGCTATCCTGACCGAGAAAACTGACGTGG AAGAAGACGAGGCCCGGACCATCGTGACCCTGGTGGCCAACGTGCGGAAC AGAAGCGGCGACGAGAATAGCAGCGGCCTGAGCCTGAGAGCCAGCCTGAT GATTGCCACCCTGGCCACCCAGCAGGACATCCCTATCGATGGCAGCGACGA GGACTTCCAGACCCTGTGCATCGACATCCTGCACCACCCCCTGACCAAGTGC CTGGACGAAGAGAACGCCAAGAGCAAGGCCGAGAAGATCATTCTCGAAGA GTGCAAGAACATCGACACCGAGGAGAAGGGTGCCCCGGGATCTGGCGCAA CAAATTTTAGTCTTTTAAAGCAGGCAGGAGACGTCGAGGAAAACCCTGGAC CCGTGAGCGAGACAAACGAGACAGGCATCTACATCTTCAGCGCCATCCAGA CAGACAAGGATGAGGAATTCGGCGCCGTGGAAGTGGAAGGGACCAAGGCT GAGACATTCCTGATCCGGTATAAGGACGCCGCCATGGTGGCCGCCGAAGTG CCCATGAAGATCTACCACCCCAACCGGCAGAACCTGCTGATGCACCAGAAT GCCGTGGCCGCCATCATGGACAAGAACGACACCGTGATCCCCATCAGCTTC GGCAACGTGTTCAAGAGCAAAGAGGACGTGAAGGTGCTCCTGGAAAACCT GTACCCCCAGTTCGAGAAGCTGTTCCCCGCCATCAAGGGAAAGATCGAAGT GGGCCTGAAGGTGATCGGCAAGAAAGAGTGGCTCGAAAAGAAAGTGAACG AGAACCCCGAGCTGGAAAAAGTGTCCGCCAGCGTGAAGGGCAAGAGCGAG GCCGCTGGCTACTACGAGAGAATCCAGCTGGGCGGCATGGCCCAGAAGATG TTCACAAGCCTGCAGAAAGAAGTGAAAACCGACGTGTTCAGCCCCCTGGAA GAAGCCGCCGAGGCCGCCAAAGCCAATGAGCCTACAGGCGAAACAATGCT GCTGAACGCCAGCTTCCTGATCAACAGAGAGGATGAGGCCAAGTTCGACGA GAAAGTCAATGAGGCCCACGAGAACTGGAAGGATAAGGCCGACTTCCACT ACAGCGGCCCCTGGCCCGCCTACAACTTCGTGAACATCCGGCTGAAGGTGG AAGAGAAGGGGGCACCTGGCTCGGGAGCGACCAACTTCTCATTACTCAAAC AAGCCGGAGACGTTGAGGAGAATCCAGGCCCTGTGCTGCACAAGCTCGTGA CCGCCCCCATCAACCTGGTCGTGAAGATCGGCGAAGGTGCAGGAAGAG GCCGACAAGCAGCTGTACGACCTGCCCACCATCCAGCAGAAGCTGATCCAG CTGCAGATGATGTTCGAGCTGGGCGAGATCCCCGAGGAAGCCTTCCAGGAA AAAGAGGACGAACTGCTGATGAGATACGAGATCGCCAAGCGGCGCGAGAT TGAGCAGTGGGAAGAACTGACCCAGAAGCGGAATGAGGAAAGCGGTGCCC CGGGATCTGGCGCAACAAATTTTAGTCTTTTAAAGCAGGCAGGAGACGTCG AGGAAAACCCTGGACCCGTGGGCGAGCTGCTGTACCTCTACGGCCTGATCC CCACCAAAGAGGCCGCTGCTATCGAGCCCTTCCCATTCTACAAGGGCTTCG ACGGCGAGCACAGCCTGTACCCTATCGCCTTCGACCAAGTGACCGCCGTGG TGTTCAAGCTGGACGCCGACACCTACAGCGAGAAAGTGATCCAGGAAAAG ATGGAACAGGACATGAGCTGGCTGCAGGAAAAGGCCTTCCACCACCACGA GACAGTGGCCGCCCTGTATGAGGAATTCACCATCATCCCCCTGAAGTTCTGC ACCATCTATAAGGGAGAGGAATCCCTGCAGGCCGCCATCGAGATCAACAAA GAGAAGATCGAAAACTCCCTGACCCTGCTGCAGGGCAACGAGGAATGGAA CGTGAAGATCTACTGCGACGACACCGAGCTGAAGAAGGGCATCAGCGAGA CAAACGAGAGCGTGAAGGCCAAGAAGCAGGAAATCAGCCACCTGAGCCCC GGCAGACAGTTCTTCGAGAAGAAGAAGATTGACCAGCTCATCGAGAAAGA GCTGGAACTGCACAAGAACAAAGTGTGCGAGGAAATCCACGACAAGCTGA TTGAGCTGAGCCTCTACGACTCCGTGAAGAAGAACTGGTCCAAGGACGTGA CAGGCGCTGCCGAACAGATGGCCTGGAACAGCGTGTTCCTGCTGCCCAGCC TGCAGATCACCAAGTTCGTGAACGAGATCGAGGAACTCCAGCAGCGGCTGG AGAACAAGGGATGGAAGTTCGAAGTGACCGGCCCCTGGCCTCCCTACCACT TCAGCAGCTTTGCCGGGGCACCTGGCTCGGGAGCGACCAACTTCTCATTACT CAAACAAGCCGGAGACGTTGAGGAGAATCCAGGCCCTGTGAGCCTGAAGC AGAGCATGGAGAATAAGGATATCGCCCTGATCGACATCCTCGACGTGATCC TGGACAAGGGAGTGGCCATCAAGGGCGACCTGATCATCTCTATCGCCGGCG TGGACCTGGTGTACCTGGATCTGAGAGTGCTGATCTCCAGCGTGGAAACCC TGGTGCAGGCCAAAGAGGGCAACCACAAGCCCATCACCAGCGAGCAGTTC GACAAGCAGAAAGAGGAGCTGATGGACGCCACCGGCCAGCCCAGCAAGTG GACAAATCCTCTGGGCAGCGGCGCTCCCGGGTCAGGTGCCACGAATTTTTC GTTGTTGAAGCAAGCTGGGGATGTTGAAGAGAACCCAGGGCCTGTGCAGCC CGTGTCCCAGGCCAACGGCAGAATCCACCTGGATCCCGATCGGGAACA GGGACTGGCCCAGCTCGTGATGACCGTGATCGAGCTGCTGCGGCAGATCGT GGAACGGCACGCCATGAGAAGAGTGGAAGGCGGCACCCTGACCGACGAGC AGATCGAGAATCTGGGAATCGCTCTGATGAACCTGGAGGAGAAGATGGAC GAGCTGAAAGAGGTGTTCGGACTGGACGCTGAGGATCTGAACATCGACCTG GGCCCTCTGGGCAGCCTGCTGGGTGCCCCGGGATCTGGCGCAACAAATTTT AGTCTTTTAAAGCAGGCAGGAGACGTCGAGGAAAACCCTGGACCCGTGGCC GTGGAACACAACATGCAGAGCAGCACCATCGTGGACGTGCTGGAAAAGAT CCTGGACAAGGGCGTCGTGATCGCCGGGACATCACAGTGGGAATCGACCTG CGTGGAACTGCTGACCATCAAGATCCGGCTGATCGTGGCCAGCGTGGACAA GGCCAAAGAAATCGGCATGGATTGTGGGAGAACGACCCCTACCTGAGCA GCAAGGGCGCCAACAACAAGGCTCTGGAAGAGGAAAACAAGATGCTGCAC GAGCGGCTGAAAACACTGGAAGAGAAGATCGAGACAAAGCGCGGGGCACC TGGCTCGGGAGCGACCAACTTCTCATTACTCAAACAAGCCGGAGACGTTGA | |

TABLE 13-continued

Exemplary GVPC construct

| Construct | Sequence | SEQ ID NO: |
|---|---|---|
| | GGAGAATCCAGGCCCTGTGAGCACCGGCCCCAGCTTCAGCACCAAGGACAA<br>CACCCTGGAATACTTCGTGAAGGCCAGCAACAAGCACGGCTTTAGCCTCGA<br>CATCAGCCTGAACGTGAATGGGGCCGTGATTAGCGGCACCATGATCAGCGC<br>CAAAGAGTACTTCGACTACCTGAGCGAGACATTCGAAGAGGGCAGCGAAGT<br>GGCCCAGGCCCTGTCTGAGCAGTTTAGCCTGGCTAGCGAGGCCTCCGAGTC<br>TAATGGCGAAGCCGAGGCCCACTTCATCCACCTGAAGAACACCAAGATCTA<br>CTGCGGCGACAGCAAGAGCACCCCCAGCAAGGGCAAGATCTTCTGGCGCGG<br>CAAGATCGCCGAGGTGGACGGATTCTTCCTGGGAAAAATCAGCGACGCCAA<br>GTCCACCAGCAAGAAGTCCAGCGGCGCTCCCGGGTCAGGTGCCACGAATTT<br>TTCGTTGTTGAAGCAAGCTGGGGATGTTGAAGAGAACCCAGGGCCTGTGGT<br>GTCCAAGGGCGAGGAACTGTTCACCGGCGTGGTGCCCATCCTGGTGGAACT<br>GGATGGCGACGTGAACGGCCACAAGTTCAGCGTGTCCGGCGAGGGCGAAG<br>GCGACGCCACATACGGAAAGCTGACCCTGAAGTTCATCTGCACCACCGGCA<br>AGCTGCCCGTGCCTTGGCCTACCCTCGTGACCACACTGACCTACGGCGTGCA<br>GTGCTTCGCCAGATACCCCGACCACATGAAGCAGCACGATTTCTTCAAGAG<br>CGCCATGCCCGAGGGCTACGTGCAGGAACGGACCATCTTCTTCAAGGACGA<br>CGGCAACTACAAGACAAGAGCCGAAGTGAAGTTCGAGGGCGACACCCTCG<br>TGAACCGGATCGAGCTGAAGGGCATCGACTTCAAAGAGGATGGCAACATCC<br>TGGGCCACAAGCTGGAGTACAACTACAACAGCCACAAGGTGTACATCACCG<br>CCGACAAGCAGAAAAACGGCATCAAAGTGAACTTCAAGACCCGGCACAAC<br>ATCGAGGACGGCAGCGTGCAGCTGGCCGACCACTACCAGCAGAACACCCCC<br>ATCGGAGATGGCCCCGTGCTGCTGCCCGACAACCACTACCTGAGCACACAA<br>AGCGCCCTGAGCAAGGACCCCAACGAGAAGCGGGACCACATGGTGCTGCT<br>GGAATTTGTGACCGCCGCTGGCATCACCCTGGGCATGGACGAGCTGTACAA<br>GTGACTCGAGTCTAGAGGGCCCCGTGGCTGTAATCTAGAGGATCCCTCGAG<br>GGGCCCAAGCTTACGCGTGCATGCGACGTCATAGCTCTCTCCCTATAGTGAG<br>TCGTATTATAAGCTAGCTTGGGATCTTTGTGAAGGAACCTTACTTCTGTGGT<br>GTGACATAATTGGACAAACTACCTACAGAGATTTAAAGCTCTAAGGTAAAT<br>ATAAAATTTTTAAGTGTATAATGTGTTAAACTAGCTGCATATGCTTGCTGCT<br>TGAGAGTTTTGCTTACTGAGTATGATTTATGAAAATATTATACACAGGAGCT<br>AGTGATTCTAATTGTTTGTGTATTTTAGATTCACAGTCCCAAGGCTCATTTCA<br>GGCCCCTCAGTCCTCACAGTCTGTTCATGATCATAATCAGCCATACCACATT<br>TGTAGAGGTTTTACTTGCTTTAAAAAACCTCCCACACCTCCCCCTGAACCTG<br>AAACATAAAATGAATGCAATTGTTGTTGTTAACTTGTTTATTGCAGCTTATA<br>ATGGTTACAAATAAAGCAATAGCATCACAAATTTCACAAATAAAGCATTTT<br>TTTCACTGCATTCTAGTTGTGGTTTGTCCAAACTCATCAATGTATCTTATCAT<br>GTCTGGATC | |

The DNA sequence for the CMV enhancer/CMV promoter used is) and the DNA sequence for SV40 polyadenylation tail used are the same reported in Table 11a above.

Example 9: Identification of Detectable Gene Clusters in Mammalian Cells

To identify a set of genes capable of assembling gas vesicles in the mammalian cell, an exemplary GVES was constructed using the exemplary GV gene cluster from *B. megaterium* reported in Table 11 above, which can be used as a Gas Vesicle Reporting Component as will be understood by a skilled person upon review of the instant disclosure.

A transient transfection screening assay was performed to allow the testing of different gas vesicle gene clusters without the need to optimize their stoichiometry and expression levels individually; although from the previous work these are expected to be important parameters.

In particular, a cell culture, transient transfection of HEK 293T and CHO-K1 cells and TEM analysis were performed as described in the material and method with various genes cluster.

An exemplary GV cluster the gvp genes of nine *B. megaterium* of Table 11 above was shown to be detectable by TEM and BURST ultrasound.

Figure 12:
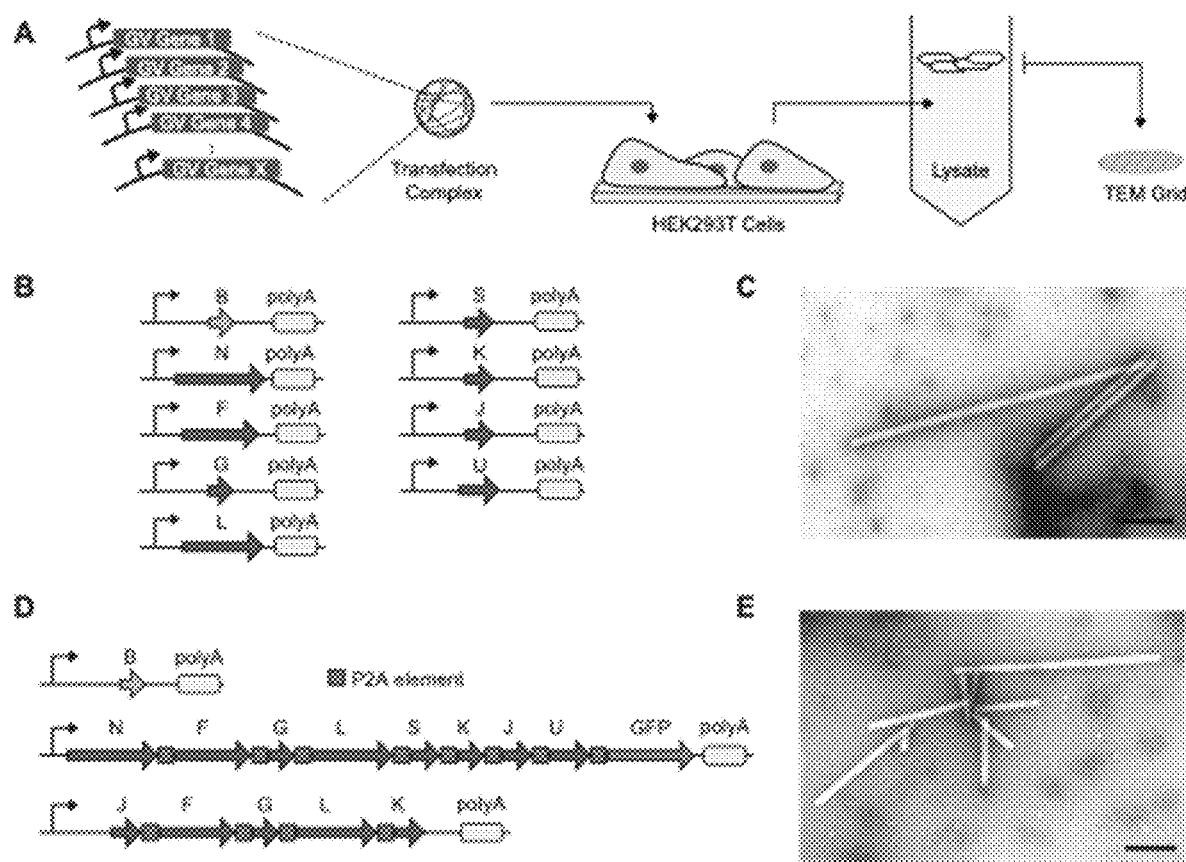
FIG. 12 illustrates an approach for engineering a mammalian cell through transformation of the cell with an exemplary GVES of the disclosure. In particular FIG. 12 Panel A shows a schematic illustration of the transient co-transfection assay used to identify combinations of genes capable of producing gas vesicles in mammalian cells.

In particular, a monocistronic GVES with the nine *B. megaterium* of Table 11 was used in the experiments illustrated in FIGS. 9 and 12.

Example 10: Identification of Bottleneck Genes in Mammalian Cells to Enable Robust GV Formation in Mammalian Cells Genes having a lower expression rate in GV constructs herein described (herein also indicated as bottleneck genes) were identified in exemplary mammalian cells HEK293T cells using an experimental approach illustrated in FIGS. 9A-9C.

Figure 9A:
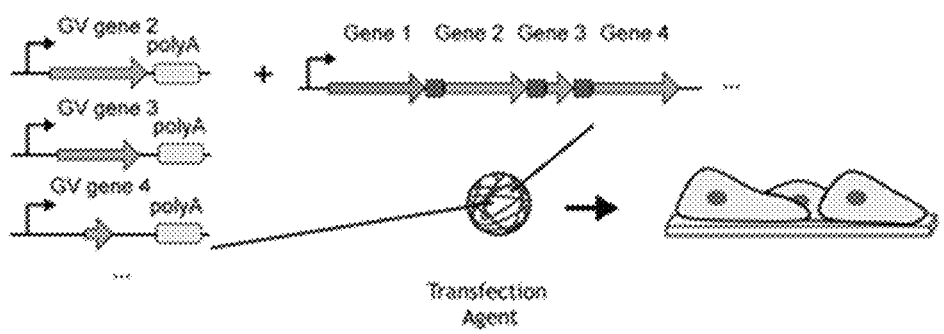
FIGS. 9A-9C illustrate an exemplary identification of bottleneck genes on an exemplary polycistronic gas vesicle gene plasmid.

In particular, test the efficiency with which gas vesicles could be formed when a given gene was supplied only on the polycistronic plasmid, and thereby identify "bottleneck" genes, the HEK293T cells were co-transfected with a monocistronic plasmid containing gvpB, 7 other monocistronic plasmids including all but the gene being assayed, and the polycistronic plasmid for example Table 13) according to the approach schematically illustrated in FIG. 9A.

Figure 9B:
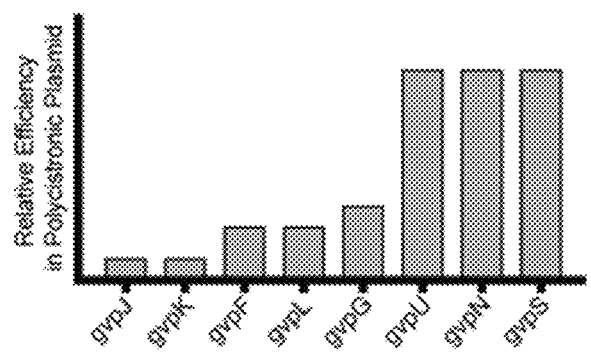
Figure 9C:
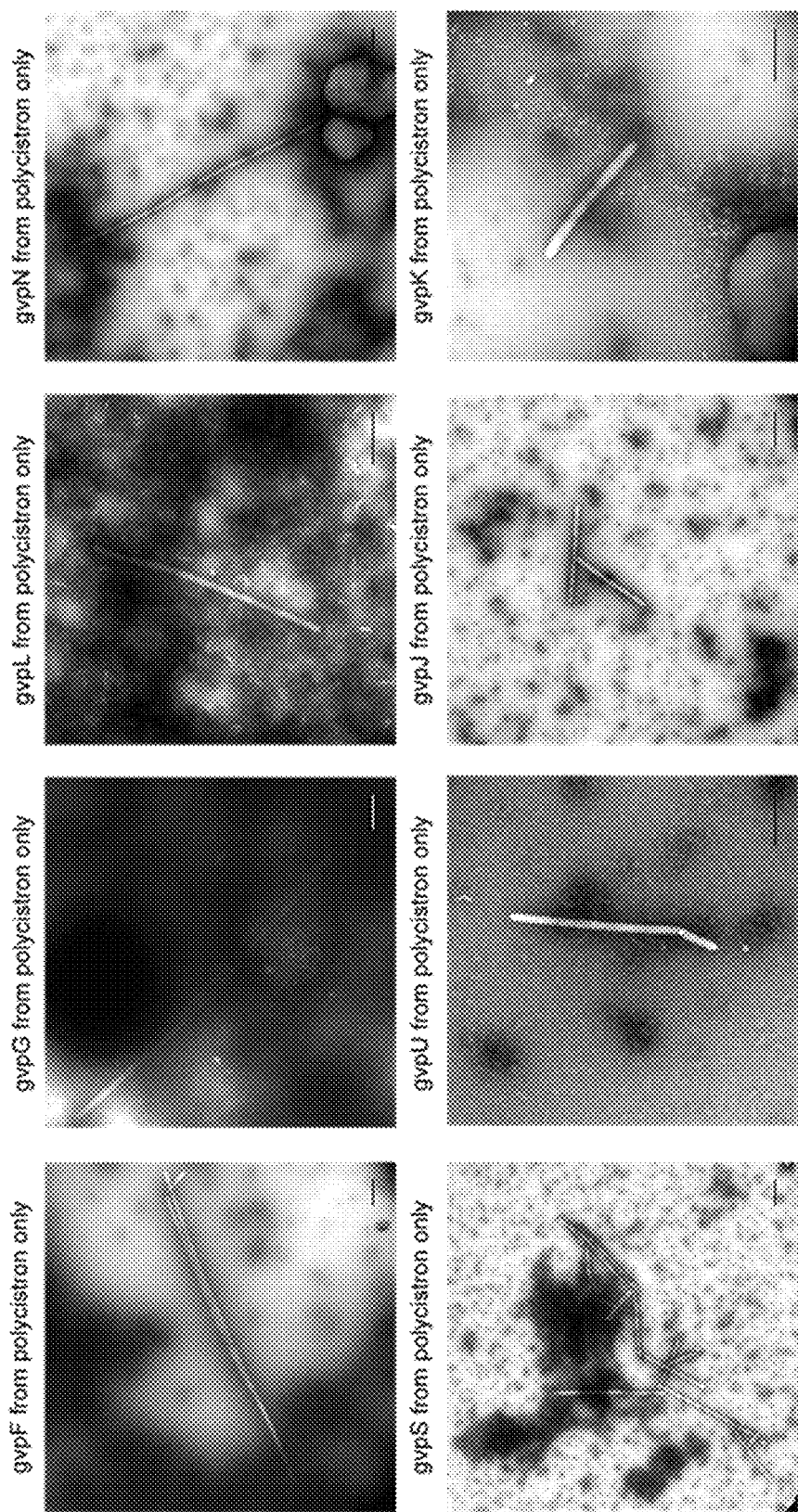

A qualitative estimate of the relative number of gas vesicles produced when each indicated gene was supplied solely by the polycistronic plasmid is reported in FIG. 9B, and representative TEM images of gas vesicles in the lysate of HEK293T cells for all 8 assays are shown in FIG. 9C.

These results suggest that gvpN, gvpS and gvpU supplied in either monocistronic or polycistronic form supported abundant gas vesicle assembly. However, the production of gas vesicles was significantly reduced when gvpJ, gvpF, gvpG, gvpL or gvpK was supplied from the polycistronic vector. Therefore, these results supported the conclusion that these genes represented a bottleneck in gas vesicle formation for the tested GV cluster.

Example 11; Optimization of Gene Stoichiometry Through Booster Construct

In order to address the stoichiometry issues raised by bottleneck genes in the exemplary *B megatherium* cluster identified in Example 12 a booster plasmid comprising duplicate cassettes for the bottleneck genes was provided.

In particular, a booster plasmid containing gvp genes J, F, G, L and K connected with p2A elements was constructed to elevate the expression of these genes in in a pCMVSport backbone.

The related sequence is reported in Table 14 below. gvpJ, F, G, L, K are separated by GAPGSG-p2A sequence.

TABLE 14

Exemplary GPVC booster construct

| Construct | Sequence | SEQ ID NO |
|---|---|---|
| CMV: gvp JFGLK: polyA | CGTTACATAACTTACGGTAAATGGCCCGCCTGGCTGACCGCCCAACGACCC CCGCCCATTGACGTCAATAATGACGTATGTTCCCATAGTAACGCCAATAGG GACTTTCCATTGACGTCAATGGGTGGAGTATTTACGGTAAACTGCCCACTT GGCAGTACATCAAGTGTATCATATGCCAAGTACGCCCCCTATTGACGTCAA TGACGGTAAATGGCCCGCCTGGCATTATGCCCAGTACATGACCTTATGGGA CTTTCCTACTTGGCAGTACATCTACGTATTAGTCATCGCTATTACCATGGTG ATGCGGTTTTGGCAGTACATCAATGGGCGTGGATAGCGGTTTGACTCACGG GGATTTCCAAGTCTCCACCCCATTGACGTCAATGGGAGTTTGTTTTGGCACC AAAATCAACGGGACTTTCCAAAATGTCGTAACAACTCCGCCCCATTGACGC AAATGGGCGGTAGGCGTGTACGGTGGGAGGTCTATATAAGCAGAGCTCGT TTAGTGAACCGTCAGATCGCCTGGAGACGCCATCCACGCTGTTTTGACCTC CATAGAAGACACCGGGACCGATCCAGCCTCCGGACTCTAGCCTAGGCTTTT GCAAAAAGCTATTTAGGTGACACTATAGAAGGTACGCCTGCAGGTACCGA GCTCGGATCCAGTACCCTTCACCATGGCCGTGGAACACAACATGCAGAGCA GCACCATCGTGGACGTGCTGGAAAAGATCCTGGACAAGGGCGTCGTGATC GCCGGGGACATCACAGTGGGAATCGCCGACGTGGAACTGCTGACCATCAA GATCCGGCTGATCGTGGCCAGCGTGGACAAGGCCAAAGAAATCGGCATGG ATTGGTGGGAGAACGACCCCTACCTGAGCAGCAAGGGCGCCAACAACAAG GCCCTGGAAGAGGAAAACAAGATGCTGCACGAGCGGCTGAAAACACTGGA AGAGAAGATCGAGACAAAGCGCGGTGCCCCGGGATCTGGCGCAACAAATT TTAGTCTTTTAAAGCAGGCAGGAGACGTCGAGGAAAACCCTGGACCCGTG AGCGAGACAAACGAGACAGGCATCTACATCTTCAGCGCCATCCAGACAGA CAAGGATGAGGAATTCGGCGCCGTGGAAGTGGAAGGGACCAAGGCTGAGA CATTCCTGATCCGGTATAAGGACGCCGCCATGGTGGCCGCCGAAGTGCCCA TGAAGATCTACCACCCCAACCGGCAGAACCTGCTGATGCACCAGAATGCC GTGGCCGCCATCATGGACAAGAACGACACCGTGATCCCCATCAGCTTCGGC AACGTGTTCAAGAGCAAAGAGGACGTGAAGGTGCTCCTGGAAAACCTGTA CCCCCAGTTCGAGAAGCTGTTCCCCGCCATCAAGGGAAAGATCGAAGTGG GCCTGAAGGTGATCGGCAAGAAAGAGTGGCTCGAAAAGAAAGTGAACGA GAACCCCGAGCTGGAAAAAGTGTCCGCCAGCGTGAAGGGCAAGAGCGAGG CCGCTGGCTACTACGAGAGAATCCAGCTGGGCGGCATGGCCCAGAAGATG TTCACAAGCCTGCAGAAAGAAGTGAAAACCGACGTGTTCAGCCCCCTGGA AGAAGCCGCCGAGGCCGCCAAAGCCAATGAGCCTACAGGCGAAACAATGC TGCTGAACGCCAGCTTCCTGATCAACAGAGAGGATGAGGCCAAGTTCGAC GAGAAAGTCAATGAGGCCCACGAGAACTGGAAGGATAAGGCCGACTTCCA CTACAGCGGCCCCTGGCCCGCCTACAACTTCGTGAACATCCGGCTGAAGGT GGAAGAGAAGGGGGCACCTGGCTCGGGAGCGACCAACTTCTCATTACTCA AACAAGCCGGAGACGTTGAGGAGAATCCAGGCCCTGTGCTGCACAAGCTC GTGACCGCCCCCATCAACCTGGTCGTGAAGATCGGCGAGAAGGTGCAGGA AGAGGCCGACAAGCAGCTGTACGACCTGCCCACCATCCAGCAGAAGCTGA TCCAGCTGCAGATGATGTTCGAGCTGGGCGAGATCCCCGAGGAAGCCTTCC AGGAAAAAGAGGACGAACTGCTGATGAGATACGAGATCGCCAAGCGGCGC GAGATTGAGCAGTGGGAAGAACTGACCCAGAAGCGGAATGAGGAAAGCG GTGCCCCGGGATCTGGCGCAACAAATTTTAGTCTTTTAAAGCAGGCAGGAG ACGTCGAGGAAAACCCTGGACCCGTGGGCGAGCTGCTGTACCTCTACGGCC TGATCCCCACCAAAGAGGCCGCTGCTATCGAGCCCTTCCCATTCTACAAGG GCTTCGACGGCGAGCACAGCCTGTACCCTATCGCCTTCGACCAAGTGACCG CCGTGGTGTTCAAGCTGGACGCCGACACCTACAGCGAGAAAGTGATCCAG GAAAAGATGGAACAGGACATGAGCTGGCTGCAGGAAAAGGCCTTCCACCA CCACGAGACAGTGGCCGCCCTGTATGAGGAATTCACCATCATCCCCCTGAA GTTCTGCACCATCTATAAGGGAGAGGAATCCCTGCAGGCCGCCATCGAGAT CAACAAAGAGAAGATCGAAAACTCCCTGACCCTGCTGCAGGGCAACGAGG AATGGAACGTGAAGATCTACTGCGACGACACCGAGCTGAAGAAGGGCATC AGCGAGACAAACGAGAGCGTGAAGGCCAAGAAGCAGGAAATCAGCCACC TGAGCCCCGGCAGACAGTTCTTCGAGAAGAAGAAGATTGACCAGCTCATC GAGAAAGAGCTGGAACTGCACAAGAACAAAGTGTGCGAGGAAATCCACG ACAAGCTGATTGAGCTGAGCCTCTACGACTCCGTGAAGAAGAACTGGTCCA AGGACGTGACAGGCGCTGCCGAACAGATGGCCTGGAACAGCGTGTTCCTG CTGCCCAGCCTGCAGATCACCAAGTTCGTGAACGAGATCGAGGAACTCCA GCAGCGGCTGGAGAACAAGGGATGGAAGTTCGAAGTGACCGGCCCCTGGC CTCCCTACCACTTCAGCAGCTTTGCCGGGGCACCTGGCTCGGGAGCGACCA ACTTCTCATTACTCAAACAAGCCGGAGACGTTGAGGAGAATCCAGGCCCTG TGCAGCCCGTGTCCCAGGCCAACGGCAGAATCCACCTGGATCCCGATCAGG | 444 |

TABLE 14-continued

Exemplary GPVC booster construct

| Construct | Sequence | SEQ ID NO |
|---|---|---|
| | CCGAACAGGGACTGGCCCAGCTCGTGATGACCGTGATCGAGCTGCTGCGG<br>CAGATCGTGGAACGGCACGCCATGAGAAGAGTGGAAGGCGGCACCCTGAC<br>CGACGAGCAGATCGAGAATCTGGGAATCGCCCTGATGAACCTGGAAGAGA<br>AGATGGACGAGCTGAAAGAGGTGTTCGGACTGGACGCCGAGGACCTGAAC<br>ATCGACCTGGGCCCTCTGGGCAGCCTGCTGTGATAATCTAGAGGATCCCTC<br>GAGGGGCCCAAGCTTACGCGTGCATGCGACGTCATAGCTCTCTCCCTATAG<br>TGAGTCGTATTATAAGCTAGCTTGGGATCTTTGTGAAGGAACCTTACTTCTG<br>TGGTGTGACATAATTGGACAAACTACCTACAGAGATTTAAAGCTCTAAGGT<br>AAATATAAAATTTTTAAGTGTATAATGTGTTAAACTAGCTGCATATGCTTG<br>CTGCTTGAGAGTTTTGCTTACTGAGTATGATTTATGAAAATATTATACACAG<br>GAGCTAGTGATTCTAATTGTTTGTGTATTTTAGATTCACAGTCCCAAGGCTC<br>ATTTCAGGCCCCTCAGTCCTCACAGTCTGTTCATGATCATAATCAGCCATAC<br>CACATTTGTAGAGGTTTTACTTGCTTTAAAAAACCTCCCACACCTCCCCCTG<br>AACCTGAAACATAAAATGAATGCAATTGTTGTTGTTAACTTGTTTATTGCA<br>GCTTATAATGGTTACAAATAAAGCAATAGCATCACAAATTTCACAAATAAA<br>GCATTTTTTCACTGCATTCTAGTTGTGGTTTGTCCAAACTCATCAATGTAT<br>CTTATCATGTCTGGATC | |

The DNA sequence for the CMV enhancer/CMV promoter used and the DNA sequence for SV40 polyadenylation tail used are the same reported in Table 11a above.

Example 12: Gas Vesicle Expression System

The GVES that includes GVPB gene expression cassette of Table 11 with the GVPC construct of Table 13 and the GVP booster plasmid of Table 14, illustrated in FIG. 12D, is able to robustly express GVs in mammalian cells as detected by TEM and BURST ultrasound. The sequences of the corresponding exemplary GVES herein are also indicated as mARG.

The GVES of this example provide a polycistronic GVES which was used in the experiments illustrated in FIGS. 9A-9C and 12 have been collected using GVES described in Example 9 for monocistronic cassettes and Example 12A for polycistronic cassettes.

Example 13: Gas Vesicle Expression System

The mARG GVES can be cloned within the piggyBac backbone are reported in Tables 15, 16 and 17 below, as illustrated in FIG. 13A, for integration in the genome of mammalian cells.

TABLE 15

Construct comprising the GVPB cassette

| Construct | SEQUENCE | SEQ ID NO: |
|---|---|---|
| Piggybac transposon containing gvpB | CCCTAGAAAGATAATCATATTGTGACGTACGTTAAAGATAAT<br>CATGTGTAAAATTGACGCATGTGTTTTATCGGTCTGTATATCG<br>AGGTTTATTTATTAATTTGAATAGATATTAAGTTTTATTATATT<br>TACACTTACATACTAATAATAAATTCAACAAACAATTTATTTA<br>TGTTTATTTATTTATTAAAAAAAACAAAAACTCAAAATTTCTT<br>CTATAAAGTAACAAAACTTTTATGAGGGACAGCCCCCCCCCA<br>AAGCCCCCAGGGATGTAATTACGTCCCTCCCCCGCTAGGGGG<br>CAGCAGCGAGCCGCCCGGGGCTCCGCTCCGGTCCGGCGCTCC<br>CCCCGCATCCCCGAGCCGGCAGCGTGCGGGGACAGCCCGGGC<br>ACGGGGAAGGTGGCACGGGATCGCTTTCCTCTGAACGCTTCT<br>CGCTGCTCTTTGAGCCTGCAGACACCTGGGGGGATACGGGGA<br>AAAGGCCTCCACGGCCACTAGTTTCACTCGAGTTTACTCCCTA<br>TCAGTGATAGAGAACGTATGAAGAGTTTACTCCCTATCAGTG<br>ATAGAGAACGTATGCAGACTTTACTCCCTATCAGTGATAGAG<br>AACGTATAAGGAGTTTACTCCCTATCAGTGATAGAGAACGTA<br>TGACCAGTTTACTCCCTATCAGTGATAGAGAACGTATCTACA<br>GTTTACTCCCTATCAGTGATAGAGAACGTATATCCAGTTTACT<br>CCCTATCAGTGATAGAGAACGTATGTCGAGGTAGGCGTGTAC<br>GGTGGGCGCCTATAAAAGCAGAGCTCGTTTAGTGAACCGTCA<br>GATCGCCTGGAGCAATTCCACAACACTTTTGTCTTATACTTGG<br>TACCTATGCATGCCACCATGAGCATCCAGAAGTCCACCAACA<br>GCAGCAGCCTGGCCGAAGTGATCGACCGGATCCTGGACAAGG<br>GCATCGTGATCGACGCCTTCGCCAGAGTGTCCGTCGTGGGCA<br>TCGAGATCCTGACCATCGAGGCCAGAGTCGTGATCGCCAGCG<br>TGGACACCTGGCTGAGATATGCCGAAGCCGTGGGCCTGCTGC<br>GGGACGACGTGGAAGAAAATGGCCTGCCCGAGCGGAGCAAC<br>AGCTCTGAGGGACAGCCCCGGTTCAGCATCTGAACTAAATCG<br>CACTGTCGGCGTCCCCCCCTAACGTTACTGGCCGAAGCCGCTT<br>GGAATAAGGCCGGTGTGCGTTTGTCTATATGTTATTTTCCACC<br>ATATTGCCGTCTTTTGGCAATGTGAGGGCCCGGAAACCTGGC<br>CCTGTCTTCTTGACGAGCATTCCTAGGGGTCTTTCCCCTCTCG<br>CCAAAGGAATGCAAGGTCTGTTGAATGTCGTGAAGGAAGCAG | 445 |

TABLE 15-continued

Construct comprising the GVPB cassette

| Construct | SEQUENCE | SEQ ID NO: |
|---|---|---|
| | TTCCTCTGGAAGCTTCTTGAAGACAAACAACGTCTGTAGCGA<br>CCCTTTGCAGGCAGCGGAACCCCCCACCTGGCGACAGGTGCC<br>TCTGCGGCCAAAAGCCACGTGTATAAGATACACCTGCAAAGG<br>CGGCACAACCCCAGTGCCACGTTGTGAGTTGGATAGTTGTGG<br>AAAGAGTCAAATGGCTCTCCTCAAGCGTATTCAACAAGGGGC<br>TGAAGGATGCCCAGAAGGTACCCCATTGTATGGGATCTGATC<br>TGGGGCCTCGGTGCACATGCTTTACATGTGTTTAGTCGAGGTT<br>AAAAAACGTCTAGGCCCCCCGAACCACGGGGACGTGGTTTTC<br>CTTTGAAAAACACGATGATAATATGGCCACAACCATGGTGAG<br>CAAGGGCGAGGAGGATAACATGGCCATCATCAAGGAGTTCAT<br>GCGCTTCAAGGTGCACATGGAGGGCTCCGTGAACGGCCACGA<br>GTTCGAGATCGAGGGCGAGGGCGAGGGCCGCCCCTACGAGG<br>GCACCCAGACCGCCAAGCTGAAGGTGACCAAGGGCGGCCCC<br>CTGCCCTTCGCCTGGGACATCCTGTCCCCTCAGTTCATGTACG<br>GCTCCAAGGCCTACGTGAAGCACCCCGCCGACATCCCCGACT<br>ACTTGAAGCTGTCCTTCCCCGAGGGCTTCAAGTGGGAGCGCG<br>TGATGAACTTCGAGGACGGCGGCGTGGTGACCGTGACCCAGG<br>ACTCCTCCCTGCAGGACGGCGAGTTCATCTACAAGGTGAAGC<br>TGCGCGGCACCAACTTCCCCTCCGACGGCCCCGTAATGCAGA<br>AGAAGACCATGGGCTGGGAGGCCTCCTCCGAGCGGATGTACC<br>CCGAGGACGGCGCCCTGAAGGGCGAGATCAAGCAGAGGCTG<br>AAGCTGAAGGACGGCGGCCACTACGACGCTGAGGTCAAGAC<br>CACCTACAAGGCCAAGAAGCCCGTGCAGCTGCCCGGCGCCTA<br>CAACGTCAACATCAAGTTGGACATCACCTCCCACAACGAGGA<br>CTACACCATCGTGGAACAGTACGAACGCGCCGAGGGCCGCCA<br>CTCCACCGGCGGCATGGACGAGCTGTACAAGTGAACTAGTTC<br>GTTAACTAAACTTGTTTATTGCAGCTTATAATGGTTACAAATA<br>AAGCAATAGCATCACAAATTTCACAAATAAAGCATTTTTTC<br>ACTGCATTCTAGTTGTGGTTTGTCCAAACTCATCAATGTATCT<br>TATCATGTCTGGAATTGACTCAAATGATGTCAATTAGTCTATC<br>AGAAGCTCATCTGGTCTCCCTTCCGGGGGACAAGACATCCCT<br>GTTTAATATTTAAACAGCAGTGTTCCCAAACTGGGTTCTTATA<br>TCCCTTGCTCTGGTCAACCAGGTTGCAGGGTTTCCTGTCCTCA<br>CAGGAACGAAGTCCCTAAAGAAACAGTGGCAGCCAGGTTTA<br>GCCCCGGAATTGACTGGATTCCTTTTTTAGGGCCCATTGGTAT<br>GGCTTTTTCCCCGTATCCCCCCAGGTGTCTGCAGGCTCAAAGA<br>GCAGCGAGAAGCGTTCAGAGGAAAGCGATCCCGTGCCACCTT<br>CCCCGTGCCCGGGCTGTCCCCGCACGCTGCCGGCTCGGGGAT<br>GCGGGGGGAGCGCCGGACCGGAGCGGAGCCCCGGGCGGCTC<br>GCTGCTGCCCCCTAGCGGGGAGGGACGTAATTACATCCCTG<br>GGGGCTTTGGGGGGGGCTGTCCCTGATATCTATAACAAGAA<br>AATATATATATAATAAGTTATCACGTAAGTAGAACATGAAAT<br>AACAATATAATTATCGTATGAGTTAAATCTTAAAAGTCACGT<br>AAAAGATAATCATGCGTCATTTTGACTCACGCGGTCGTTATA<br>GTTCAAAATCAGTGACACTTACCGCATTGACAAGCACGCCTC<br>ACGGGAGCTCCAAGCGGCGACTGAGATGTCCTAAATGCACAG<br>CGACGGATTCGCGCTATTTAGAAAGAGAGCAATATTTCAA<br>GAATGCATGCGTCAATTTTACGCAGACTATCTTTCTAGGG | |

TABLE 16

GVPC construct comprising one additional GVP cassette

| Construct | SEQUENCE | SEQ ID NO: |
|---|---|---|
| PiggyBac<br>transposon<br>containing<br>gvpNFGLS<br>KJU-<br>EmGFP | CCCTAGAAAGATAATCATATTGTGACGTACGTTAAAGATAAT<br>CATGTGTAAAATTGACGCATGTGTTTTATCGGTCTGTATATCG<br>AGGTTTATTTATTAATTTGAATAGATATTAAGTTTTATTATATT<br>TACACTTACATACTAATAATAAATTCAACAAACAATTTATTTA<br>TGTTTATTTATTTATTAAAAAAAACAAAACTCAAATTTCTT<br>CTATAAAGTAACAAAACTTTTATGAGGGACAGCCCCCCCCA<br>AAGCCCCCAGGGATGTAATTACGTCCCTCCCCCGCTAGGGGG<br>CAGCAGCGAGCCGCCCGGGGCTCCGCTCCGGTCCGGCGCTCC<br>CCCCGCATCCCCGAGCCGGCAGCGTGCGGGGACAGCCCGGGC<br>ACGGGGAAGGTGGCACGGGATCGCTTTCCTCTGAACGCTTCT<br>CGCTGCTCTTTGAGCCTGCAGACACCTGGGGGATACGGGGA<br>AAAGGCCTCCACGGCCACTAGTTTCACTCGAGTTTACTCCCTA<br>TCAGTGATAGAGAACGTATGAAGAGTTTACTCCCTATCAGTG<br>ATAGAGAACGTATGCAGACTTTACTCCCTATCAGTGATAGAG<br>AACGTATAAGGAGTTTACTCCCTATCAGTGATAGAGAACGTA<br>TGACCAGTTTACTCCCTATCAGTGATAGAGAACGTATCTACA<br>GTTTACTCCCTATCAGTGATAGAGAACGTATATCCAGTTTACT<br>CCCTATCAGTGATAGAGAACGTATGTCGAGGTAGGCGTGTAC | 446 |

TABLE 16-continued

GVPC construct comprising one additional GVP cassette

| Construct | SEQUENCE | SEQ ID NO: |
|---|---|---|
| | GGTGGGCGCCTATAAAAGCAGAGCTCGTTTAGTGAACCGTCA | |
| | GATCGCCTGGAGCAATTCCACAACACTTTTGTCTTATACTTGG | |
| | TACCTATGCATGCCACCATGACCGTGCTGACCGACAAGCGGA | |
| | AGAAGGGCAGCGGCGCCTTCATCCAGGACGACGAGACAAAA | |
| | GAGGTGCTGAGCAGAGCCCTGAGCTACCTGAAGTCCGGCTAC | |
| | AGCATCCACTTCACCGGACCTGCCGGCGGAGGCAAGACATCT | |
| | CTGGCTAGAGCCCTGGCCAAGAAACGGAAGCGGCCCGTGATG | |
| | CTGATGCACGGCAACCACGAGCTGAACAACAAGGACCTGATC | |
| | GGCGATTTCACCGGCTACACCAGCAAAAAGGTGATCGACCAG | |
| | TACGTGCGGAGCGTGTACAAGAAAGACGAACAGGTGTCCGA | |
| | GAACTGGCAGGACGGCAGACTGCTGGAAGCCGTGAAGAATG | |
| | GCTACACCCTGATCTACGACGAGTTCACCAGAAGCAAGCCCG | |
| | CTACCAACAACATCTTCCTGAGCATCCTTGAGGAGGGCGTGC | |
| | TGCCCCTGTACGGCGTGAAGATGACCGACCCTTTCGTGCGCG | |
| | TGCACCCCGACTTCAGAGTGATCTTTACCAGCAACCCCGCCG | |
| | AGTATGCCGGCGTGTACGATACCCAGGACGCCCTGCTGGACC | |
| | GGCTGATCACCATGTTCATCGACTACAAGGACATCGACCGGG | |
| | AAACCGCTATCCTGACCGAGAAAACTGACGTGGAAGAAGAC | |
| | GAGGCCCGGACCATCGTGACCCTGGTGGCCAACGTGCGGAAC | |
| | AGAAGCGGCGACGAGAATAGCAGCGGCCTGAGCCTGAGAGC | |
| | CAGCCTGATGATTGCCCACCCTGGCCACCCAGCAGGACATCCC | |
| | TATCGATGGCAGCGACGAGGACTTCCAGACCCTGTGCATCGA | |
| | CATCCTGCACCACCCCCTGACCAAGTGCCTGGACAAGAGAA | |
| | CGCCAAGAGCAAGGCCGAGAAGATCATTCTCGAAGAGTGCA | |
| | AGAACATCGACACCGAGGAGAAGGGTGCCCCGGGATCTGGC | |
| | GCAACAAATTTTAGTCTTTTAAAGCAGGCAGGAGACGTCGAG | |
| | GAAAACCCTGGACCCGTGAGCGAGACAAACGAGACAGGCAT | |
| | CTACATCTTCAGCGCCATCCAGACAGACAAGGATGAGGAATT | |
| | CGGCGCCGTGGAAGTGGAAGGGACCAAGGCTGAGACATTCCT | |
| | GATCGGTATAAGGACGCCGCCATGGTGGCCGCCGAAGTGCC | |
| | CATGAAGATCTACCACCCCAACCGGCAGAACCTGCTGATGCA | |
| | CCAGAATGCCGTGGCCGCCATCATGGACAAGAACGACACCGT | |
| | GATCCCCATCAGCTTCGGCAACGTGTTCAAGAGCAAAGAGGA | |
| | CGTGAAGGTGCTCCTGGAAAACCTGTACCCCCAGTTCGAGAA | |
| | GCTGTTCCCCGCCATCAAGGGAAAGATCGAAGTGGGCCTGAA | |
| | GGTGATCGGCAAGAAAGAGTGGCTCGAAAAGAAAGTGAACG | |
| | AGAACCCCGAGCTGGAAAAAGTGTCCGCCAGCGTGAAGGGC | |
| | AAGAGCGAGGCCGCTGGCTACTACGAGAGAATCCAGCTGGG | |
| | CGGCATGGCCCAGAAGATGTTCACAAGCCTGCAGAAAGAAGT | |
| | GAAAACCGACGTGTTCAGCCCCCTGGAAGAAGCCGCCGAGGC | |
| | CGCCAAAGCCAATGAGCCTACAGGCGAAACAATGCTGCTGAA | |
| | CGCCAGCTTCCTGATCAACAGAGAGGATGAGGCCAAGTTCGA | |
| | CGAGAAAGTCAATGAGGCCCACGAGAACTGGAAGGATAAGG | |
| | CCGACTTCCACTACAGCGGCCCCTGGCCCGCCTACAACTTCGT | |
| | GAACATCCGGCTGAAGGTGGAAGAGAAGGGGGCACCTGGCT | |
| | CGGGAGCGACCAACTTCTCATTACTCAAACAAGCCGGAGACG | |
| | TTGAGGAGAATCCAGGCCCTGTGCTGCACAAGCTCGTGACCG | |
| | CCCCCATCAACCTGGTCGTGAAGATCGGCGAGAAGGTGCAGG | |
| | AAGAGGCCGACAAGCAGCTGTACGACCTGCCCACCATCCAGC | |
| | AGAAGCTGATCCAGCTGCAGATGATGTTCGAGCTGGGCGAGA | |
| | TCCCCGAGGAAGCCTTCCAGGAAAAGAGGACGAACTGCTG | |
| | ATGAGATACGAGATCGCCAAGCGGCGCGAGATTGAGCAGTG | |
| | GGAAGAACTGACCCAGAAGCGGAATGAGGAAAGCGGTGCCC | |
| | CGGGATCTGGCGCAACAAATTTTAGTCTTTTAAAGCAGGCAG | |
| | GAGACGTCGAGGAAAACCCTGGACCCGTGGGCGAGCTGCTGT | |
| | ACCTCTACGGCCTGATCCCCACCAAAGAGGCCGCTGCTATCG | |
| | AGCCCTTCCCATTCTACAAGGGCTTCGACGGCGAGCACAGCC | |
| | TGTACCCTATCGCCTTCGACCAAGTGACCGCCGTGGTGTTCAA | |
| | GCTGGACGCCGACACCTACAGCGAGAAAGTGATCCAGGAAA | |
| | AGATGGAACAGGACATGAGCTGGCTGCAGGAAAAGGCCTTC | |
| | CACCACCACGAGACAGTGGCCGCCCTGTATGAGGAATTCACC | |
| | ATCATCCCCCTGAAGTTCTGCACCATCTATAAGGGAGAGGAA | |
| | TCCCTGCAGGCCGCCATCGAGATCAACAAAGAAGATCGAA | |
| | AACTCCCTGACCCTGCTGCAGGGCAACGAGGAATGGAACGTG | |
| | AAGATCTACTGCGACGACACCGAGCTGAAGGGCATCAG | |
| | CGAGACAAACGAGAGCGTGAAGGCCAAGAAGCAGGAAATCA | |
| | GCCACCTGAGCCCCGGCAGACAGTTCTTCGAGAAGAAGAAGA | |
| | TTGACCAGCTCATCGAGAAAGAGCTGGAACTGCACAAGAACA | |
| | AAGTGTGCGAGGAAATCCACGACAAGCTGATTGAGCTGAGCC | |
| | TCTACGACTCCGTGAAGAAGAACTGGTCCAAGGACGTGACAG | |
| | GCGCTGCCGAACAGATGGCCTGGAACAGCGTGTTCCTGCTGC | |
| | CCAGCCTGCAGATCACCAAGTTCGTGAACGAGATCGAGGAAC | |
| | TCCAGCAGCGGCTGGAGAACAAGGGATGGAAGTTCGAAGTG | |
| | ACCGGCCCCTGGCCTCCCTACCACTTCAGCAGCTTTGCCGGGG | |
| | CACCTGGCTCGGGAGCGACCAACTTCTCATTACTCAAACAAG | |
| | CCGGAGACGTTGAGGAGAATCCAGGCCCTGTGAGCCTGAAGC | |

TABLE 16-continued

GVPC construct comprising one additional GVP cassette

| Construct | SEQUENCE | SEQ ID NO: |
|---|---|---|
| | AGAGCATGGAGAATAAGGATATCGCCCTGATCGACATCCTCG | |
| | ACGTGATCCTGGACAAGGGAGTGGCCATCAAGGGCGACCTGA | |
| | TCATCTCTATCGCCGGCGTGGACCTGGTGTACCTGGATCTGAG | |
| | AGTGCTGATCTCCAGCGTGGAAACCCTGGTGCAGGCCAAAGA | |
| | GGGCAACCACAAGCCCATCACCAGCGAGCAGTTCGACAAGC | |
| | AGAAAGAGGAGCTGATGGACGCCACCGGCCAGCCCAGCAAG | |
| | TGGACAAATCCTCTGGGCAGCGGCGCTCCCGGGTCAGGTGCC | |
| | ACGAATTTTTCGTTGTTGAAGCAAGCTGGGGATGTTGAAGAG | |
| | AACCCAGGGCCTGTGCAGCCCGTGTCCCAGGCCAACGGCAGA | |
| | ATCCACCTGGATCCCGATCAGGCCGAACAGGGACTGGCCCAG | |
| | CTCGTGATGACCGTGATCGAGCTGCTGCGGCAGATCGTGGAA | |
| | CGGCACGCCATGAGAAGAGTGGAAGGCGGCACCCTGACCGA | |
| | CGAGCAGATCGAGAATCTGGGAATCGCTCTGATGAACCTGGA | |
| | GGAGAAGATGGACGAGCTGAAAGAGGTGTTCGGACTGGACG | |
| | CTGAGGATCTGAACATCGACCTGGGCCCTCTGGGCAGCCTGC | |
| | TGGGTGCCCCGGGATCTGGCGCAACAAATTTTAGTCTTTTAAA | |
| | GCAGGCAGGAGACGTCGAGGAAAACCCTGGACCCGTGGCCG | |
| | TGGAACACAACATGCAGAGCAGCACCATCGTGGACGTGCTGG | |
| | AAAAGATCCTGGACAAGGGCGTCGTGATCGCCGGGGACATCA | |
| | CAGTGGGAATCGCCGACGTGGAACTGCTGACCATCAAGATCC | |
| | GGCTGATCGTGGCCAGCGTGGACAAGGCCAAAGAAATCGGC | |
| | ATGGATTGGTGGGAGAACGACCCCTACCTGAGCAGCAAGGGC | |
| | GCCAACAACAAGGCTCTGGAAGAGGAAAACAAGATGCTGCA | |
| | CGAGCGGCTGAAAACACTGGAAGAGAAGATCGAGACAAAGC | |
| | GCGGGGCACCTGGCTCGGGAGCGACCAACTTCTCATTACTCA | |
| | AACAAGCCGGAGACGTTGAGGAGAATCCAGGCCCTGTGAGC | |
| | ACCGGCCCCAGCTTCAGCACCAAGGACAACACCCTGGAATAC | |
| | TTCGTGAAGGCCAGCAACAAGCACGGCTTTAGCCTCGACATC | |
| | AGCCTGAACGTGAATGGGGCCGTGATTAGCGGCACCATGATC | |
| | AGCGCCAAAGAGTACTTCGACTACCTGAGCGAGACATTCGAA | |
| | GAGGGCAGCGAAGTGGCCCAGGCCCTGTCTGAGCAGTTTAGC | |
| | CTGGCTAGCGAGGCCTCCGAGTCTAATGGCGAAGCCGAGGCC | |
| | CACTTCATCCACCTGAAGAACACCAAGATCTACTGCGGCGAC | |
| | AGCAAGAGCACCCCCAGCAAGGGCAAGATCTTCTGGCGCGGC | |
| | AAGATCGCCGAGGTGGACGGATTCTTCCTGGGAAAAATCAGC | |
| | GACGCCAAGTCCACCAGCAAGAAGTCCAGCGGCGCTCCCGGG | |
| | TCAGGTGCCACGAATTTTTCGTTGTTGAAGCAAGCTGGGGAT | |
| | GTTGAAGAGAACCCAGGGCCTGTGGTGTCCAAGGGCGAGGA | |
| | ACTGTTCACCGGCGTGGTGCCCATCCTGGTGGAACTGGATGG | |
| | CGACGTGAACGGCCACAAGTTCAGCGTGTCCGGCGAGGGCGA | |
| | AGGCGACGCCACATACGGAAAGCTGACCCTGAAGTTCATCTG | |
| | CACCACCGGCAAGCTGCCCGTGCCTTGGCCTACCCTCGTGAC | |
| | CACACTGACCTACGGCGTGCAGTGCTTCGCCAGATACCCCGA | |
| | CCACATGAAGCAGCACGATTTCTTCAAGAGCGCCATGCCCGA | |
| | GGGCTACGTGCAGGAACGGACCATCTTCTTCAAGGACGACGG | |
| | CAACTACAAGACAAGAGCCGAAGTGAAGTTCGAGGGCGACA | |
| | CCCTCGTGAACCGGATCGAGCTGAAGGGCATCGACTTCAAAG | |
| | AGGATGGCAACATCCTGGGCCACAAGCTGGAGTACAACTACA | |
| | ACAGCCACAAGGTGTACATCACCGCCGACAAGCAGAAAAAC | |
| | GGCATCAAAGTGAACTTCAAGACCCGGCACAACATCGAGGAC | |
| | GGCAGCGTGCAGCTGGCCGACCACTACCAGCAGAACACCCCC | |
| | ATCGGAGATGGCCCCGTGCTGCTGCCCGACAACCACTACCTG | |
| | AGCACACAAAGCGCCCTGAGCAAGGACCCCAACGAGAAGCG | |
| | GGACCACATGGTGCTGCTGGAATTTGTGACCGCCGCTGGCAT | |
| | CACCCTGGGCATGGACGAGCTGTACAAGTGAACTAGTTCGTT | |
| | AACTAAACTTGTTTATTGCAGCTTATAATGGTTACAAATAAAG | |
| | CAATAGCATCACAAATTTCACAAATAAAGCATTTTTTTCACTG | |
| | CATTCTAGTTGTGGTTTGTCCAAACTCATCAATGTATCTTATC | |
| | ATGTCTGGAATTGACTCAAATGATGTCAATTAGTCTATCAGA | |
| | AGCTCATCTGGTCTCCCTTCCGGGGACAAGACATCCCTGTTT | |
| | AATATTTAAACAGCAGTGTTCCCAAACTGGGTTCTTATATCCC | |
| | TTGCTCTGGTCAACCAGGTTGCAGGGTTTCCTGTCCTCACAGG | |
| | AACGAAGTCCCTAAAGAAACAGTGGCAGCCAGGTTTAGCCCC | |
| | GGAATTGACTGGATTCCTTTTTTAGGGCCCATTGGTATGGCTT | |
| | TTTCCCCGTATCCCCCCAGGTGTCTGCAGGCTCAAAGAGCAG | |
| | CGAGAAGCGTTCAGAGGAAAGCGATCCCGTGCCACCTTCCCC | |
| | GTGCCCGGGCTGTCCCCGCACGCTGCCGGCTCGGGGATGCGG | |
| | GGGGAGCGCCGGACCGGAGCGGAGCCCCGGCGGCTCGCTG | |
| | CTGCCCCCTAGCGGGGAGGGACGTAATTACATCCCTGGGGG | |
| | CTTTGGGGGGGGCTGTCCCTGATATCTATAACAAGAAAATA | |
| | TATATATAATAAGTTATCACGTAAGTAGAACATGAAATAACA | |
| | ATATAATTATCGTATGAGTTAAATCTTAAAAGTCACGTAAAA | |

TABLE 16-continued

GVPC construct comprising one additional GVP cassette

| Construct | SEQUENCE | SEQ ID NO: |
|---|---|---|
| | GATAATCATGCGTCATTTTGACTCACGCGGTCGTTATAGTTCA<br>AAATCAGTGACACTTACCGCATTGACAAGCACGCCTCACGGG<br>AGCTCCAAGCGGCGACTGAGATGTCCTAAATGCACAGCGACG<br>GATTCGCGCTATTTAGAAAGAGAGAGCAATATTTCAAGAATG<br>CATGCGTCAATTTTACGCAGACTATCTTTCTAGGG | |

TABLE 17

Exemplary Booster Construct

| Construct | SEQUENCE | SEQ ID NO: |
|---|---|---|
| PiggyBac transposon containing gvpJFGLK | CCCTAGAAAGATAATCATATTGTGACGTACGTTAAAGATAAT<br>CATGTGTAAAATTGACGCATGTGTTTTATCGGTCTGTATATCG<br>AGGTTTATTTATTAATTTGAATAGATATTAAGTTTTATTATATT<br>TACACTTACATACTAATAATAAATTCAACAAACAATTTATTTA<br>TGTTTATTTATTTATTAAAAAAAACAAAAACTCAAATTTCTT<br>CTATAAAGTAACAAAACTTTTATGAGGGACAGCCCCCCCCCA<br>AAGCCCCCAGGGATGTAATTACGTCCCTCCCCCGCTAGGGGG<br>CAGCAGCGAGCCGCCCGGGGCTCCGCTCCGGTCCGGCGCTCC<br>CCCCGCATCCCCGAGCCGGCAGCGTGCGGGACAGCCCGGGC<br>ACGGGGAAGGTGGCACGGGATCGCTTTCCTCTGAACGCTTCT<br>CGCTGCTCTTTGAGCCTGCAGACACCTGGGGGGATACGGGGA<br>AAAGGCCTCCACGGCCACTAGTTTTCCCCGAAAAGTGCCACC<br>TGACGTCGGCAGTGAAAAAAATGCTTTATTTGTGAAATTTGT<br>GATGCTATTGCTTTATTTGTAACCATTATAAGCTGCAATAAAC<br>AAGTTAACAACAACAATTGCATTCATTTTTATGTTTCAGGTTCA<br>GGGGGAGGTGTGGGAGGTTTTTTAAAGCAAGTAAAACCTCTA<br>CAAATGTGGTATGGCTGATTATGATCCTCTAGACATATGCTGC<br>AGTCACTTGTACAGCTCATCCATGCCCAGGGTGATGCCAGCG<br>GCGGTCCGAAATTCCAGCAGCACCATGTGGTCCCGCTTCTCGT<br>TGGGGTCCTTGCTCAGCACGCTCTGGGTGCTCAGGTAGTGGCT<br>ATCAGGCAGCAGCACGGGCCATCTCCGATGGGGTGTTCTG<br>CTGGTAGTGGTCGGCCAGCTGCACGCTGCCATCTTCCACGTTG<br>TGCCGGATCTTGAAGTTCACTTTGATGCCGTTTTTCTGCTTCA<br>CGGCCATGATGTAGATGTTGTGGCTGTTGAAGTTGTACTCCAG<br>CTTGTGGCCCAGGATGTTGCCGTCCTCTTTGAAGTCCACGCCC<br>TTCAGCTCGATCCGGTTCACGAGGGTGTCGCCCTCGAACTTCA<br>CTTCGGCTCTGGTCTTGTAGGTGCCGTCGTCCTTGAAGAAGAT<br>GGTCCGTTCCTGCACGTAGCCCTCGGGCATGGCGCTCTTGAA<br>GAAATCGTGCTGCTTCATGTGGTCGGGGTATCTGGCGAAGCA<br>CTGCACGCCGTGAGACAGTGTGGTCACGAGGGTAGGCCAAGG<br>CACGGGCAGCTTGCCGGTGGTGCAGATGAACTTCAGGGTCAG<br>CTTGCCATTTGTGGCGTCGCCTTCGCCCTCTCCCCGCACAGAG<br>AACTTGTGGCCGTTCACGTCGCCATCCAGTTCCACCAGGATG<br>GGCACCACGCCGGTGAACAGTTCCTCGCCCTTGGACACCATG<br>GTGAAGGGTACTGGATCCGAGCTCGGTACCTGCAGGCGTACC<br>TTCTATAGTGTCACCTAAATGCGATCTGACGGTTCACTAAACG<br>AGCTCTGCTTATATAGGCCTCCCACCGTACACGCCACCTCGAC<br>ATACTCGAGTTTACTCCCTATCAGTGATAGAGAACGTATGAA<br>GAGTTTACTCCCTATCAGTGATAGAGAACGTATGCAGACTTT<br>ACTCCCTATCAGTGATAGAGAACGTATAAGGAGTTTACTCCC<br>TATCAGTGATAGAGAACGTATGACCAGTTTACTCCCTATCAGT<br>GATAGAGAACGTATCTACAGTTTACTCCCTATCAGTGATAGA<br>GAACGTATATCCAGTTTACTCCCTATCAGTGATAGAGAACGT<br>ATGTCGAGGTAGGCGTGTACGGTGGGCGCCTATAAAAGCAGA<br>GCTCGTTTAGTGAACCGTCAGATCGCCTGGAGCAATTCCACA<br>ACACTTTTGTCTTATACTTGGTACCTATGCATGCCACCATGGC<br>CGTGGAACACAACATGCAGAGCAGCACCATCGTGGACGTGCT<br>GGAAAAGATCCTGGACAAGGGCGTCGTGATCGCCGGGGACA<br>TCACAGTGGGAATCGCCGACGTGGAACTGCTGACCATCAAGA<br>TCCGGCTGATCGTGGCCAGCGTGGACAAGGCCAAAGAAATCG<br>GCATGGATTGGTGGGAGAACGACCCCTACCTGAGCAGCAAGG<br>GCGCCAACAACAAGGCCCTGGAAGAGGAAAACAAGATGCTG<br>CACGAGCGGCTGAAAACACTGGAAGAGAAGATCGAGACAAA<br>GCGCGGTGCCCCGGGATCTGGCGCAACAAATTTTAGTCTTTTA<br>AAGCAGGCAGGAGACGTCGAGGAAAACCCTGGACCCGTGAG<br>CGAGACAAACGAGACAGGCATCTACATCTTCAGCGCCATCCA<br>GACAGACAAGGATGAGGAATTCGGCGCCGTGGAAGTGGAAG<br>GGACCAAGGCTGAGACATTCCTGATCCGGTATAAGGACGCCG<br>CCATGGTGGCCGCCGAAGTGCCCATGAAGATCTACCACCCCA<br>ACCGGCAGAACCTGCTGATGCACCAGAATGCCGTGGCCGCCA<br>TCATGGACAAGAACGACACCGTGATCCCCATCAGCTTCGGCA | 447 |

TABLE 17-continued

Exemplary Booster Construct

| Construct | SEQUENCE | SEQ ID NO: |
|---|---|---|
| | ACGTGTTCAAGAGCAAAGAGGACGTGAAGGTGCTCCTGGAA | |
| | AACCTGTACCCCCAGTTCGAGAAGCTGTTCCCCGCCATCAAG | |
| | GGAAAGATCGAAGTGGGCCTGAAGGTGATCGGCAAGAAAGA | |
| | GTGGCTCGAAAAGAAAGTGAACGAGAACCCCGAGCTGGAAA | |
| | AAGTGTCCGCCAGCGTGAAGGGCAAGAGCGAGGCCGCTGGC | |
| | TACTACGAGAGAATCCAGCTGGGCGGCATGGCCCAGAAGATG | |
| | TTCACAAGCCTGCAGAAAGAAGTGAAAACCGACGTGTTCAGC | |
| | CCCCTGGAAGAAGCCGCCGAGGCCGCCAAAGCCAATGAGCCT | |
| | ACAGGCGAAACAATGCTGCTGAACGCCAGCTTCCTGATCAAC | |
| | AGAGAGGATGAGGCCAAGTTCGACGAGAAAGTCAATGAGGC | |
| | CCACGAGAACTGGAAGGATAAGGCCGACTTCCACTACAGCGG | |
| | CCCCTGGCCCGCCTACAACTTCGTGAACATCCGGCTGAAGGT | |
| | GGAAGAGAAGGGGGCACCTGGCTCGGGAGCGACCAACTTCT | |
| | CATTACTCAAACAAGCCGGAGACGTTGAGGAGAATCCAGGCC | |
| | CTGTGCTGCACAAGCTCGTGACCGCCCCCATCAACCTGGTCGT | |
| | GAAGATCGGCGAGAAGGTGCAGGAAGAGGCCGACAAGCAGC | |
| | TGTACGACCTGCCCACCATCCAGCAGAAGCTGATCCAGCTGC | |
| | AGATGATGTTCGAGCTGGGCGAGATCCCCGAGGAAGCCTTCC | |
| | AGGAAAAAGAGGACGAACTGCTGATGAGATACGAGATCGCC | |
| | AAGCGGCGCGAGATTGAGCAGTGGGAAGAACTGACCCAGAA | |
| | GCGGAATGAGGAAAGCGGTGCCCCGGGATCTGGCGCAACAA | |
| | ATTTTAGTCTTTTAAAGCAGGCAGGAGACGTCGAGGAAAACC | |
| | CTGGACCCGTGGGCGAGCTGCTGTACCTCTACGGCCTGATCC | |
| | CCACCAAAGAGGCCGCTGCTATCGAGCCCTTCCCATTCTACA | |
| | AGGGCTTCGACGGCGAGCACAGCCTGTACCCTATCGCCTTCG | |
| | ACCAAGTGACCGCCGTGGTGTTCAAGCTGGACGCCGACACCT | |
| | ACAGCGAGAAAGTGATCCAGGAAAAGATGGAACAGGACATG | |
| | AGCTGGCTGCAGGAAAAGGCCTTCCACCACCACGAGACAGTG | |
| | GCCGCCCTGTATGAGGAATTCACCATCATCCCCCTGAAGTTCT | |
| | GCACCATCTATAAGGGAGAGGAATCCCTGCAGGCCGCCATCG | |
| | AGATCAACAAAGAGAAGATCGAAAACTCCCTGACCCTGCTGC | |
| | AGGGCAACGAGGAATGGAACGTGAAGATCTACTGCGACGAC | |
| | ACCGAGCTGAAGAAGGGCATCAGCGAGACAAACGAGAGCGT | |
| | GAAGGCCAAGAAGCAGGAAATCAGCCACCTGAGCCCCGGCA | |
| | GACAGTTCTTCGAGAAGAAGAAGATTGACCAGCTCATCGAGA | |
| | AAGAGCTGGAACTGCACAAGAACAAAGTGTGCGAGGAAATC | |
| | CACGACAAGCTGATTGAGCTGAGCCTCTACGACTCCGTGAAG | |
| | AAGAACTGGTCCAAGGACGTGACAGGCGCTGCCGAACAGAT | |
| | GGCCTGGAACAGCGTGTTCCTGCTGCCCAGCCTGCAGATCAC | |
| | CAAGTTCGTGAACGAGATCGAGGAACTCCAGCAGCGGCTGGA | |
| | GAACAAGGGATGGAAGTTCGAAGTGACCGGCCCCTGGCCTCC | |
| | CTACCACTTCAGCAGCTTTGCCGGGGCACCTGGCTCGGGAGC | |
| | GACCAACTTCTCATTACTCAAACAAGCCGGAGACGTTGAGGA | |
| | GAATCCAGGCCCTGTGCAGCCCGTGTCCCAGGCCAACGGCAG | |
| | AATCCACCTGGATCCCGATCAGGCCGAACAGGGACTGGCCCA | |
| | GCTCGTGATGACCGTGATCGAGCTGCTGCGGCAGATCGTGGA | |
| | ACGGCACGCCATGAGAAGAGTGGAAGGCGGCACCCTGACCG | |
| | ACGAGCAGATCGAGAATCTGGGAATCGCCCTGATGAACCTGG | |
| | AAGAGAAGATGGACGAGCTGAAAGAGGTGTTCGGACTGGAC | |
| | GCCGAGGACCTGAACATCGACCTGGGCCCTCTGGGCAGCCTG | |
| | CTGTGAACTAGTTCGATACCGTCGACCGTTAACTAAACTTGTT | |
| | TATTGCAGCTTATAATGGTTACAAATAAAGCAATAGCATCAC | |
| | AAATTTCACAAATAAAGCATTTTTTTCACTGCATTCTAGTTGT | |
| | GGTTTGTCCAAACTCATCAATGTATCTTATCATGTCTGGAATT | |
| | GACTCAAATGATGTCAATTAGTCTATCAGAAGCTCATCTGGTC | |
| | TCCCTTCCGGGGGACAAGACATCCCTGTTTAATATTTAAACAG | |
| | CAGTGTTCCCAAACTGGGTTCTTATATCCCTTGCTCTGGTCAA | |
| | CCAGGTTGCAGGGTTTCCTGTCCTCACAGGAACGAAGTCCCT | |
| | AAAGAAACAGTGGCAGCCAGGTTTAGCCCCGGAATTGACTGG | |
| | ATTCCTTTTTTAGGGCCCATTGGTATGCTTTTTCCCCGTATCC | |
| | CCCCAGGTGTCTGCAGGCTCAAAGAGCAGCGAGAAGCGTTCA | |
| | GAGGAAAGCGATCCCGTGCCACCTTCCCCGTGCCCGGGCTGT | |
| | CCCCGCACGCTGCCGGCTCGGGGATGCGGGGGGAGCGCCGG | |
| | ACCGGAGCGGAGCCCCGGGCGGCTCGCTGCTGCCCCCTAGCG | |
| | GGGGAGGGACGTAATTACATCCCTGGGGGCTTTGGGGGGGGG | |
| | CTGTCCCTGATATCTATAACAAGAAAATATATATATAATAAG | |
| | TTATCACGTAAGTAGAACATGAAATAACAATATAATTATCGT | |
| | ATGAGTTAAATCTTAAAAGTCACGTAAAAGATAATCATGCGT | |
| | CATTTTGACTCACGCGGTCGTTATAGTTCAAAATCAGTGACAC | |
| | TTACCGCATTGACAAGCACGCCTCACGGGAGCTCCAAGCGGC | |
| | GACTGAGATGTCCTAAATGCACAGCGACGGATTCGCGCTATT | |
| | TAGAAAGAGAGAGCAATATTTCAAGAATGCATGCGTCAATTT | |
| | TACGCAGACTATCTTTCTAGGG | |

The DNA sequence for the additional regulatory regions of the cassettes are reported in Table 18 below.

TABLE 18

Additional elements of GV gene expression cassettes

| Element | Sequence | SEQ ID NO |
|---|---|---|
| 5'ITR | CCCTAGAAAGATAATCATATTGTGACGTACGTTAAAGATAAT CATGTGTAAAATTGACGCATGTGTTTTATCGGTCTGTATATC GAGGTTTATTTATTAATTTGAATAGATATTAAGTTTTATTATA TTTACACTTACATACTAATAATAAATTCAACAAACAATTTAT TTATGTTTATTTATTTATTAAAAAAAACAAAAACTCAAATT TCTTCTATAAAGTAACAAAACTTTTA | 448 |
| 5' insulator element | GAGGGACAGCCCCCCCCCAAAGCCCCCAGGGATGTAATTACGTC CCTCCCCCGCTAGGGGGCAGCAGCGAGCCGCCCGGGGCTCCGCT CCGGTCCGGCGCTCCCCCCGCATCCCCGAGCCGGCAGCGTGCGGG GACAGCCCGGGCACGGGGAAGGTGGCACGGGATCGCTTTCCTCT GAACGCTTCTCGCTGCTCTTTGAGCCTGCAGACACCTGGGGGAT ACGGGGAAAA | 449 |
| TRE3G promoter | GAGTTTACTCCCTATCAGTGATAGAGAACGTATGAAGAGTTTACT CCCTATCAGTGATAGAGAACGTATGCAGACTTTACTCCCTATCAG TGATAGAGAACGTATAAGGAGTTTACTCCCTATCAGTGATAGAGA ACGTATGACCAGTTTACTCCCTATCAGTGATAGAGAACGTATCTA CAGTTTACTCCCTATCAGTGATAGAGAACGTATATCCAGTTTACT CCCTATCAGTGATAGAGAACGTATGTCGAGGTAGGCGTGTACGGT GGGCGCCTATAAAAGCAGAGCTCGTTTAGTGAACCGTCAGATCG CCTGGAGCAATTCCACAACACTTTTGTCTTATACTT | 450 |
| SV40 polyadenylation tail | AACTTGTTTATTGCAGCTTATAATGGTTACAAATAAAGCAATAGC ATCACAAATTTCACAAATAAAGCATTTTTTTCACTGCATTCTAGTT GTGGTTTGTCCAAACTCATCAATGTATCTTA | 451 |
| 3' insulator element | TTTTCCCCGTATCCCCCCAGGTGTCTGCAGGCTCAAAGAGCAGCG AGAAGCGTTCAGAGGAAAGCGATCCCGTGCCACCTTCCCCGTGCC CGGGCTGTCCCCGCACGCTGCCGGCTCGGGGATGCGGGGGGAGC GCCGGACCGGAGCGGAGCCCCGGGCGGCTCGCTGCTGCCCCCTA GCGGGGGAGGGACGTAATTACATCCCTGGGGGCTTTGGGGGGGG GCTGTCCCT | 452 |
| 3' IRT | GATATCTATAACAAGAAAATATATATATAATAAGTTATCACGTAA GTAGAACATGAAATAACAATATAATTATCGTATGAGTTAAATCTT AAAAGTCACGTAAAAGATAATCATGCGTCATTTTGACTCACGCGG TCGTTATAGTTCAAAATCAGTGACACTTACCGCATTGACAAGCAC GCCTCACGGGAGCTCCAAGCGGCGACTGAGATGTCCTAAATGCA CAGCGACGGATTCGCGCTATTTAGAAAGAGAGAGCAATATTTCA AGAATGCATGCGTCAATTTTACGCAGACTATCTTTCTAGGG | 453 |

The GVES exemplified here has been used in the experiments illustrated in FIGS. 11, and 13-24.

Example 14: Identification of Cassettes Resulting in Expression of GV in Mammalian Cells Experiments were performed that can be used to identify the elements of a cassette for the expression of GV genes in mammalian cells inclusive of regulatory genes and gene configuration with the GVES and regulatory regions reported in Example 13 above.

A first set of experiments was performed to identify the features of an exemplary genetic construct to be used to express exemplary GV genes in a mammalian cell.

In particular a genetic construct was provided configured to obtain stable genomic integration of mCherry in HEK-293 cells. The construct schematically shown in FIG. 10A contained a 5'ITR for piggyBac transposase, chicken beta-globin insulator, TRE3G promoter upstream of the mCherry sequence and SV40 polyadenylation element downstream, followed by a chicken beta-globin insulator and 3'ITR for piggyBac transposase.

Figure 10A:
FIGS. 10A-10B illustrate testing of regulatory genes in a genetic construct and sorting of resulting cell line.

HEK-293 cells were transfected with the construct of FIG. 10A and plasmid encoding the piggyBac transposase, and subjected to FACS. And the genomic integration of the construct was detected as reported in FIG. 10B.

Figure 10B:
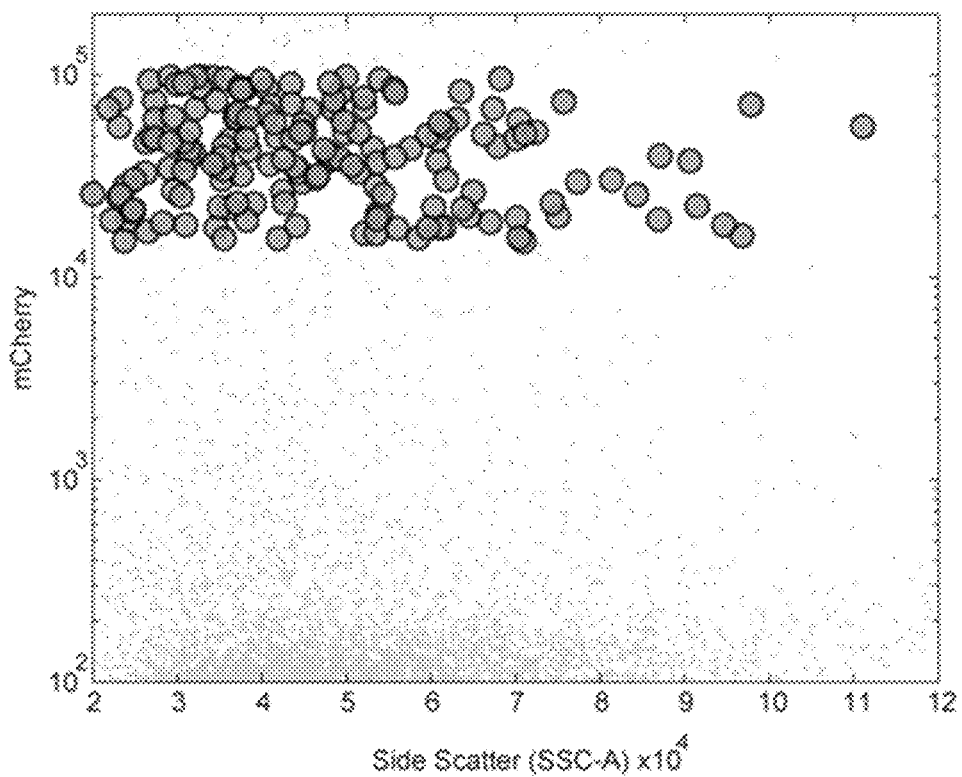
Figure 11:
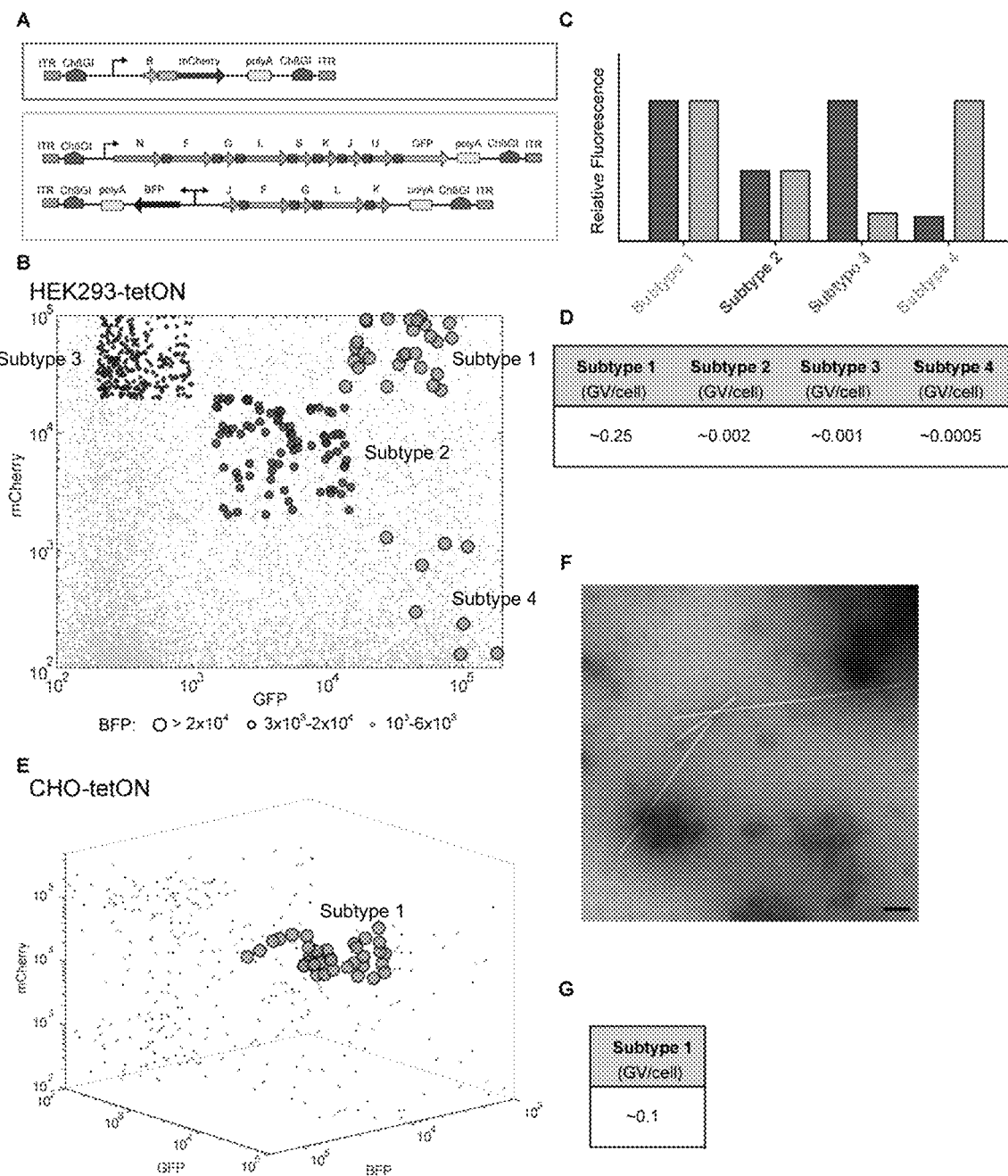
FIG. 11 illustrates results of fluorescence activated cell sorting of HEK293-tetON and CHO-tetON cells transfected with integrating mARG constructs herein described.

The regulatory regions of the above construct were therefore used to express the exemplary GVES of Example 13 herein also indicated as mARG, and in particular the three constructs were provided using the regulatory sequences tested in FIGS. 10A-10B, one including a GVPB cassette and one including a GPC construct as shown in FIG. 11 panel A.

The constructs of FIG. 11 panel A were used to generate polyclonal cell in HEK293-tetON cells and the fluorescence activated cell sorting of the HEK293-tetON cells transfected with integrating mARG constructs of FIG. 11 panel A.

FACS results of mARG-expressing HEK293-tetON cells. Cells were binned in different relative expression levels, subtypes 1-4 illustrated FIG. 11 panel B and C, showed that while all subtypes produced GVs but some subtypes expressed different amounts of average gas vesicles per cell (FIG. 11 Panel D).

Similar experiments were performed in CHO-tetON which were further transfected with the constructs of FIG. 11 panel A to generate polyclonal cell in the CHO-tetON.

The FACS of mARG-expressing CHO-tetON cells are reported in FIG. 11 panel E, representative TEM image of buoyancy-enriched lysate from CHO-tetON cells sorted are reported in FIG. 11 panel G and the approximate gas vesicle yield for the sorted mARG-expressing CHO-tetON cells. is reported in FIG. 11 Panel G. Result illustrates that mARG-expression in different mammalian cells, for example HEK293 and CHO-K1, is possible.

Example 15: Transfection and Expression of an Exemplary GV Gene Cluster with GVES Codon-optimized gas vesicle genes from Table 8 were cloned from different microbial species into unique monocistronic plasmids and mammalian cells were transiently transfected using polyethylenimine nanoparticles (FIG. 12, panel A).

This assay uses the combination of two stochastic events to sample a broad range of gene stoichiometries and expression levels. First, the heterogeneous loading of plasmids in each nanoparticle and second, the variable delivery of each nanoparticle to the nucleus results in a combinatorial distribution of plasmid copy numbers during each transfection experiment.

Upon transfection, the cells were allowed to express the gas vesicle proteins for 72 hours and then gently lysed. The lysate was centrifuged to buoyancy-enrich any fully formed gas vesicles. Finally, the top fraction of the lysate was analyzed under transmission electron microscopy for presence and phenotype of gas vesicles.

Transfection of the gas vesicle genes from *Halobacteria salinarum* and *Anabaena flos-aquae* did not lead to the formation of detectable gas vesicles in mammalian cells with transmission electron microscopy (see Example 25), however, the genes from *Bacillus megaterium* reported in Example 12were able to produce gas vesicles in mammalian cells detectable with the transmission microscopy detection method (FIG. 12, panel B).

The co-transfection of these three plasmids (see Example 12) was sufficient for robust expression of gas vesicles in cells, herein referred to as mammalian acoustic reporter gene (mammalian ARG) (FIG. 12, panel C).

The first plasmid encodes gas vesicle protein B, the second encodes all assembly factors and the third encodes the proteins requiring a boost in expression (FIG. 12 Panel D).

Accordingly, a polycistronic plasmid was constructed containing eight gas vesicle genes connected with the porcine teschovirus-1 2A self-cleavage (p2A) element as schematically shown in FIG. 12, Panel D.

In particular, the schematic illustration of FIG. 12, panel D (middle and bottom) shows an exemplary polycistronic configuration according to the disclosure.

The construct in the middle of panel D comprises gvpN, F, G, L, S, K, J and U with two adjacent genes separated by a 2A self-cleaving element which is further exemplified in Example 12 and Table 16 above. The construct at the bottom of panel D comprises gvpJ, F, G, L, and K with two adjacent genes separated by a self-cleaving element, exemplified in Table 17.

However, the gene stoichiometry of the one-to-one architecture of the illustration of FIG. 12 panel D (middle, Table 16) was not optimal since the co-transfection of this plasmid together with a plasmid that encoded for gas vesicle protein B and did not lead to detectable gas vesicles expression in mammalian cells. By assaying for the relative efficiency of gas vesicle protein expression from each gene in this plasmid it became apparent that three gas vesicle genes (N, S and U) could be expressed to lower levels compared with gas vesicle genes J, F, G, L and K.

A booster plasmid was therefore provided to further express vesicle genes J, F, G, L and K which is further described in Example 12 and Table 17 above.

Example 16: Mammalian ARG can be Genomically Integrated

Figure 13:
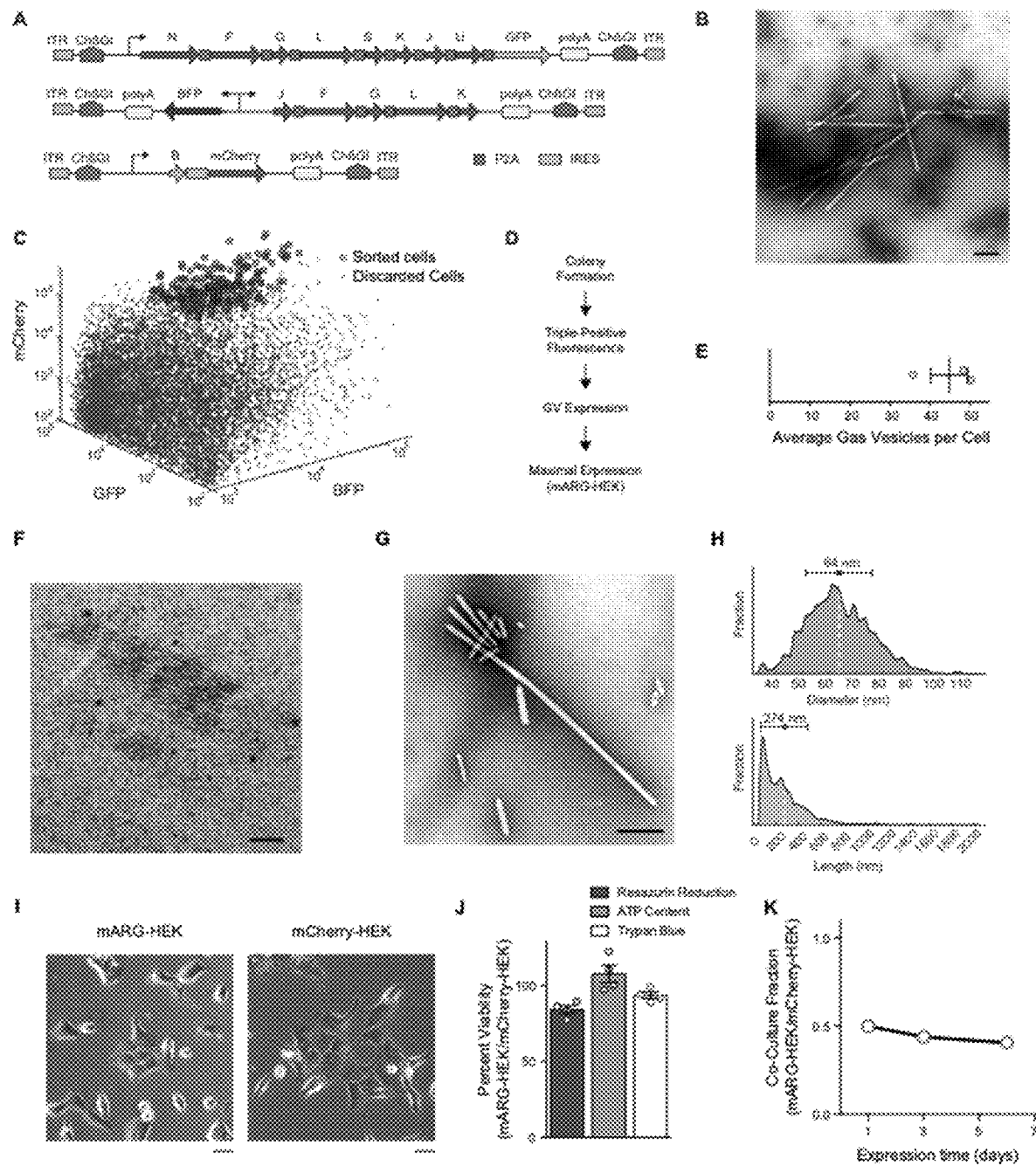
FIG. 13 illustrates formation, properties and non-toxicity of gas vesicles in cells with genome-integrated mammalian acoustic reporter genes.

To test the generalizability of the mammalian ARG, the mARG formed in Example 13 was genomically integrated in human embryonic kidney (HEK) cells as well as Chinese hamster ovary cells, allowing them to express gas vesicles, as exemplified in FIG. 11, using the construct illustrated in FIG. 11 panel A and FIG. 13 panel A.

Mammalian ARGs behaved similarly in both cell lines and using transmission electron microscopy. An average yield of one gas vesicle for every four cells was estimated (FIG. 11, panel D and G for HEK-tetON and CHO-tetON, respectively). This indicated that a subpopulation of cells was optimally producing gas vesicles. FIG. 13, panel B illustrates a representative image of gas vesicles in the cytosol of HEK cells.

To select for this subpopulation, FIG. 13 panel C and D, the Applicant screened 30 monoclonal HEK cells and 20% of the cell lines produced on average greater than one gas vesicle per cell.

Figure 16:
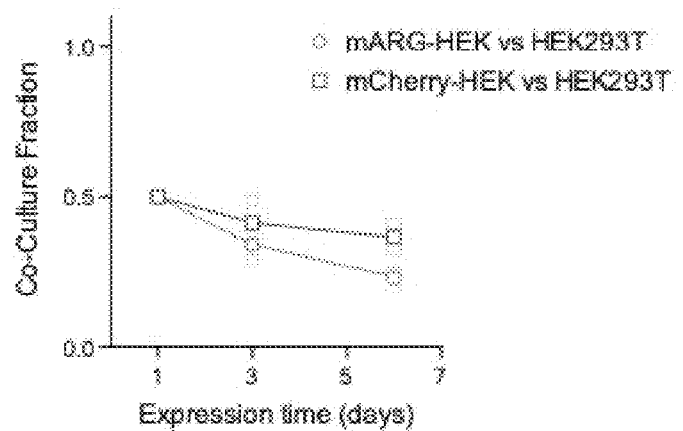
FIG. 16 shows a graph illustrating the co-culture of reporter gene expressing cells with HEK293T cells. Fraction of mARG-HEK cells in co-culture with HEK293T cells (circle) or mARG-mCherry cells in co-culture with HEK293T cells (square) seeded in equal numbers over 6 days of gene expression (n=3 biological replicates, each from 4 technical replicates, with darker dots showing the mean).
Figure 17:
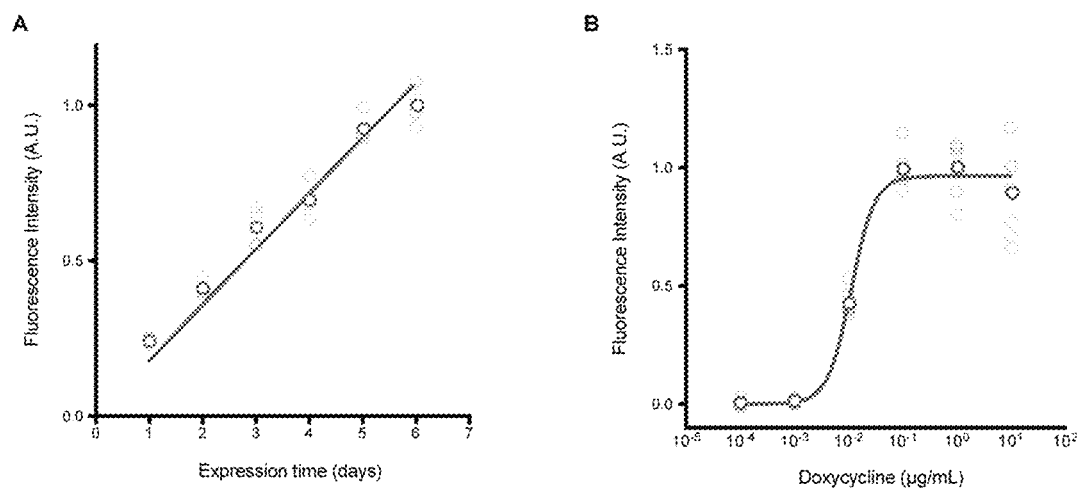
FIG. 17 shows fluorescence measurements of gene expression as a function of time and inducer concentration in mARG-HEK cells.

The cell line yielding the highest expression of gas vesicles produced on average 45 gas vesicles per cell (FIG. 13, panel E) when induced with 1 µg/mL of doxycycline and 5 mM sodium butyrate for 72 hours, and the Applicant focused on this cell line for the remainder of this work. Importantly, the expression of gas vesicles was not toxic to cells as determined using five different assays. These included observing that the shape of cells expressing mARGs did not change as a result of mARG-expression, FIG. 13 panel I, including membrane integrity with trypan blue, relative number of metabolically active cells with CellTiter-Glo®, and metabolic activity using Resazurin reduction (FIG. 13, panel J), as well as including a 6-day co-culture of mARG-HEK cells showed only a minor growth disadvantage compared with mCherry-HEK cells (FIG. 13 panel K. In addition, a co-culture of mARG-HEK and HEK293T was compared with mCherry-HEK and HEK293T cells over 6-days was assayed for fraction of co-culture (FIG. 16). This showed that the expression of reporter genes (here mARG and mCherry) led to decrease in the fraction of reporter gene-expressing cells relative to HEK293T cells.

Using transmission electron microscopy, as exemplified in FIG. 13 panel G, the average gas vesicles produced in this cell line were measured to be 64±12 nm (standard deviation) wide and 276±212 nm (standard deviation) long with some reaching aspect ratios greater than 30 (lengths larger than 1 micron) (FIG. 13, panel H). This corresponds to an average gas vesicles volume of 0.605 attoliters (ranging from 0.008-10 attoliters), assuming a tapered cylindrical shape as will be understood by a skilled person. Representative TEM image of a 60-nm section through an mARG-HEK cell showing an angled slice through two bundles of gas vesicles in the cytosol in FIG. 13 panel F.

Example 17: Ultrasound Imaging of Mammalian ARG-Expressing Cells

From previous studies, it was anticipated that gas vesicles encoded by the *B. megaterium* gene cluster will linearly scatter ultrasound signal (scattering the same ultrasound frequency that was insonated). Due to the strong linear scattering of ultrasound by mammalian cells this can lead to a challenge for detecting any added echogenicity from the expressed gas vesicles.

To address this, the Applicant turned to the unique physical property of gas vesicles in order to extract a unique acoustic signature from the expressed gas vesicles. In particular Applicant surprisingly found that acoustic fields with pressures beyond the collapsing threshold of gas vesicles will cause a rapid change in volume, which will transiently distort the insonated acoustic field (FIG. 14, panel A) (see U.S. application Ser. No. 16/736,581 entitled "BURST Ultrasound Reconstruction with Signal Templates and related Methods and Systems" filed on Jan. 7, 2020 herein incorporated by reference in its entirety).

Figure 14:
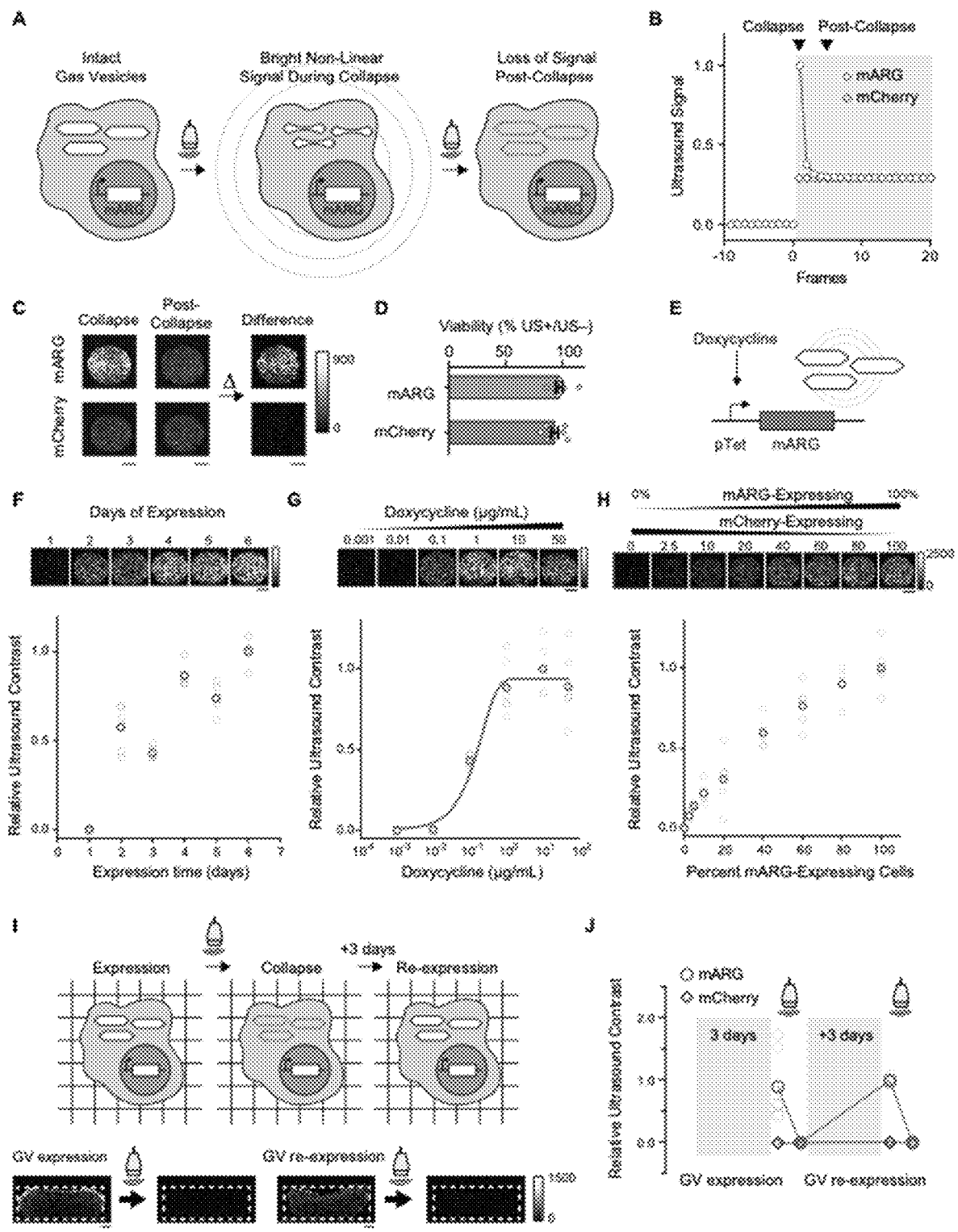
FIG. 14 illustrates an exemplary ultrasound imaging of mammalian gene expression in vitro.

This can be used to sensitively detect gas vesicles-specific nonlinear signals at the moment of collapse. To image this, serial amplitude modulation images were acquired during and after the collapse of gas vesicles. This allows for the discrimination of the steady-state background signal from the delta function-like signal obtained from the collapse of gas vesicles (FIG. 14, panels B and C). During the serial acquisition, each amplitude modulation sequence extracts non-linear ultrasound echoes by sending two half-amplitude echoes that are digitally subtracted from a third full amplitude echo. Using this imaging paradigm, any cytotoxicity from the collapse of gas vesicles was not observed (FIG. 14, panel D).

Using this new ultrasound imaging paradigm, the Applicant is interested in measuring the different characteristics of mammalian ARGs in vitro. To measure the effect of expression length on the ultrasound intensity, cells where allowed to express gas vesicles for the specified number of days and $6\times10^6$ cells were loaded into acoustically transparent agarose phantoms. After two days, cells expressing gas vesicles produced robust ultrasound contrast which increased with respect to expression duration (FIG. 14, panel F). Similar results are obtained by measuring fluorescence from the mCherry reporter expressed by the same cells expressed under the same conditions (FIG. 17A).

Example 18: Using Mammalian ARGs to Monitor Circuit-Driven Gene Expression

It is often desirable to obtain a readout of the dynamic cellular function of cells the body, for example, to investigate the activation of immune cells at the site of disease or the dynamics of a genetic pathway.

To test if mammalian ARGs can faithfully monitor circuit-driven gene expression, the Applicant measured the ultrasound response of the exemplary mammalian ARGs of Example 13 under the control of the tetracycline-inducible promoter (using reverse tetracycline-controlled transactivator). FIG. 14, panel E illustrates mARGs controlled by a conditional promoter (e.g. tetracycline-inducible promoter). The ultrasound contrast produced by cells followed the expected transfer function of the promoter, as measured by fluorescence (FIG. 17, panel B), confirming the ability of mARGs to follow the dynamics of cells using ultrasound (FIG. 14, panel G).

Next, the Applicant sought to identify the sensitivity of detecting mARG-expressing cells in a mixed cell population. For this, control cells that only expressing mCherry together with gas vesicle-expressing cells were combined at varying ratios. The Applicant was able to sensitively detect cells down a 2.5% of total cells, corresponding to 0.5% volumetric densities or approximately 4 cells per voxel (FIG. 14, panel H). This sensitivity is expected to be sufficient for in vivo scenarios.

An alternative method to monitor the dynamics of gene expression or the movement of cells is to erase the signal of a region and monitoring the return of that signal. This is a method called acoustic recovery after collapse (ARC), analogous to fluorescence recovery after photobleaching (FRAP). In addition, in many imaging experiments, the output of a gene circuit is read out only once. However, in some cases, it may be desirable to track gene expression over time. To test the above descriptions, the Applicant tested whether mARG-expressing cells in which the gas vesicles have been collapsed during imaging could re-express these reporters to allow additional imaging. mARG-HEK cells cultured in a nutrient-supported hydrogel produced clear ultrasound contrast 3 days after induction and were able to re-express their acoustic reporters over three additional days (FIG. 14, panel I and J).

Example 19: Mammalian ARGs Enable Ultrasound Imaging of Gene Expression In Vivo

Having characterized the core capabilities of mammalian ARGs for monitoring cellular location and function in vitro, the Applicant set out in this example to test if this new tool can be used for in vivo studies.

Figure 15:
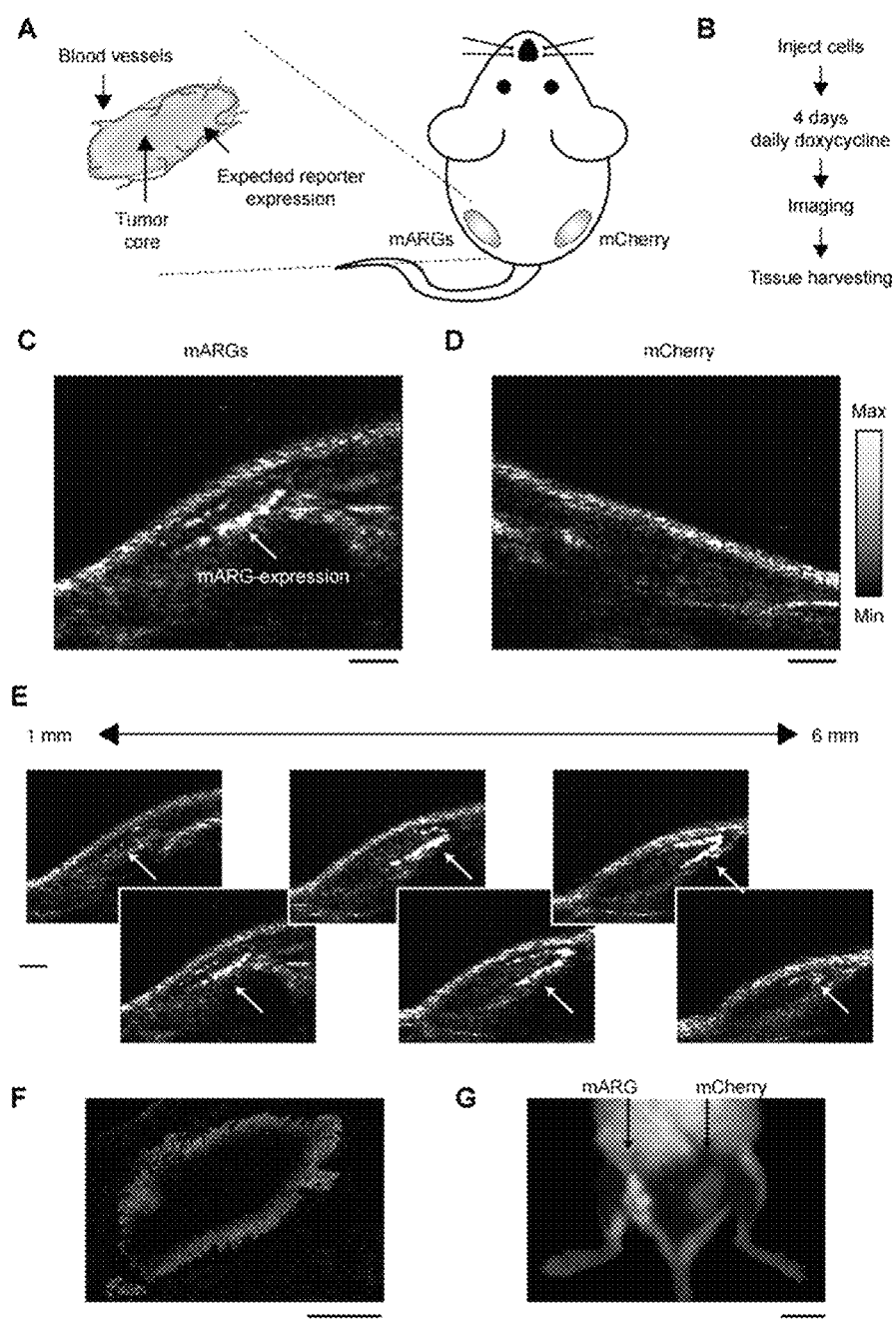
FIG. 15 illustrates an exemplary ultrasound imaging of mammalian gene expression in vivo.

ARG-expressing mammalian cells were introduced subcutaneously in the left flank of mice while loading mCherry-only control cells in their right flank (FIG. 15, panel A). The reporter genes in both cells were under the control of the tetracycline-inducible protomer, as a result the mice were intraperitoneally injected with 75 µg doxycycline and 25 mg sodium butyrate on a daily basis (FIG. 15 panel B). After the cells were allowed to express their respective reporter genes, fluorescence and ultrasound contrast of the cells was collected. The Applicant was able to for the first time monitor gene expression in vivo with great spatial resolution using BURST ultrasound (FIG. 15, panel C and FIG. 22A, panel A). Ultrasound imaging of control tumor expressing mCherry did not produce BURST ultrasound signal (FIG. 15, panel D and FIG. 22A).

Figure 19:
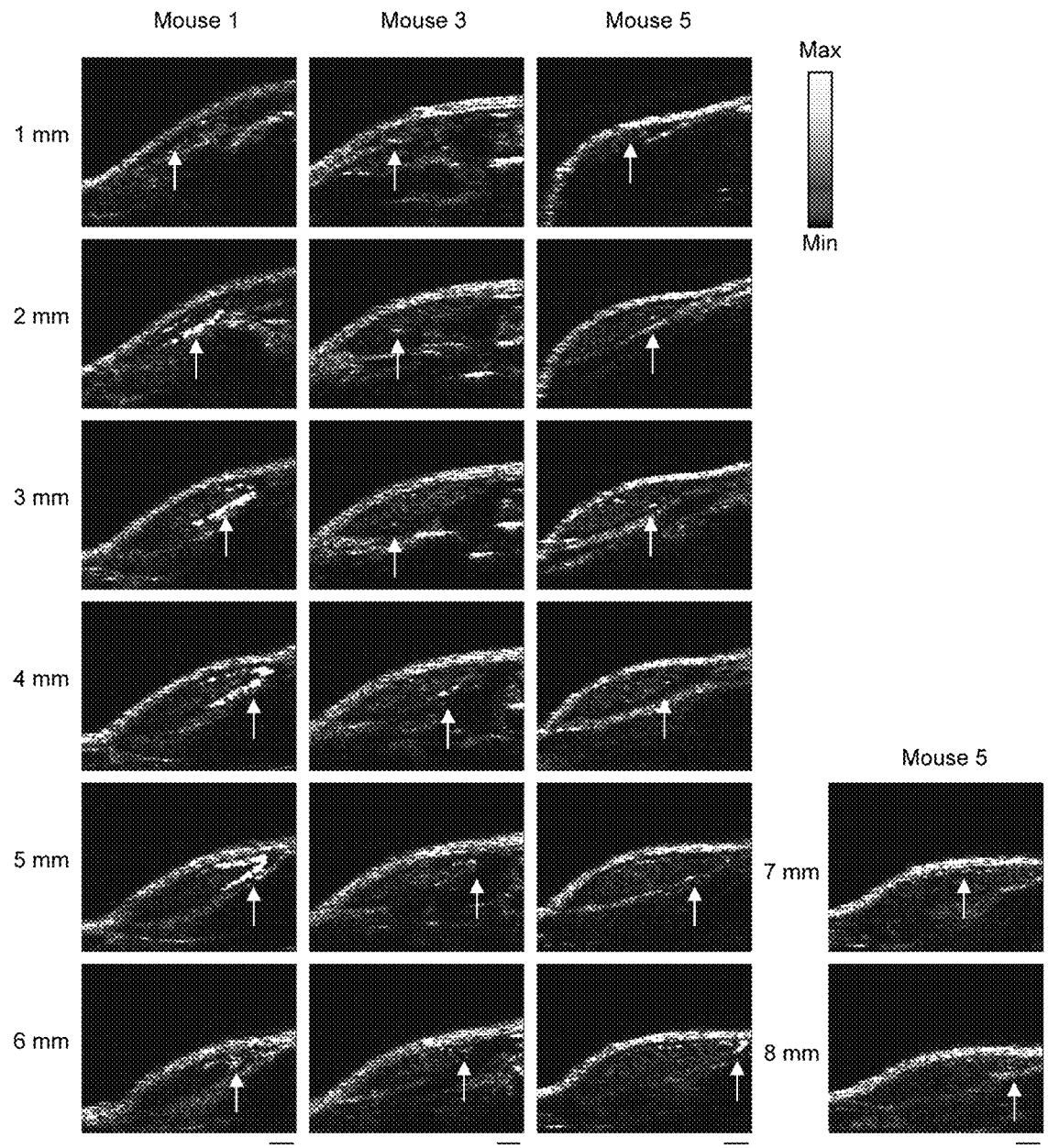
FIG. 19 shows exemplary in vivo ultrasound images of adjacent planes in mARG-HEK tumors acquired at 1 mm intervals. For each imaging slice the difference heatmap of nonlinear signal between frame 1 and frame 4 is overlaid on grayscale anatomical scale. Minimum and maximum values of color bar are 4000 and 40000, respectively. White arrows indicate location of mARG-specific BURST ultrasound signal. Scale bars are 1 mm.
Figure 20:
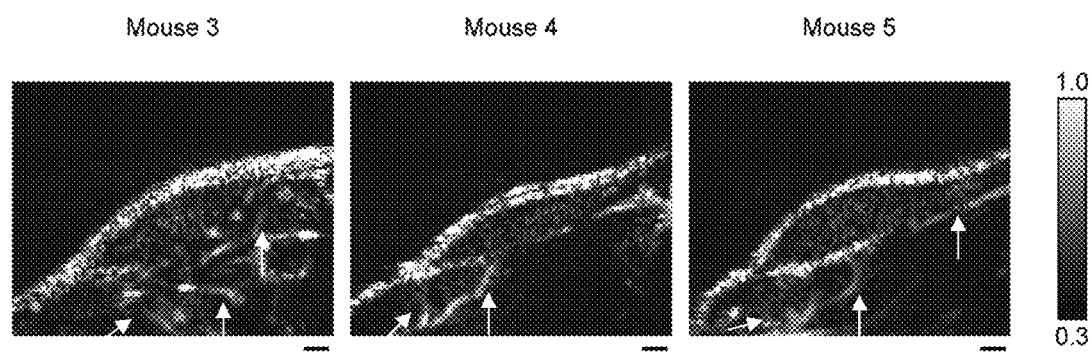
FIG. 20 shows representative Doppler ultrasound images of tumors containing mARG-HEK cells. Doppler ultrasound images were acquired using 250 frames of ultrafast planewaves at 25V and used to reconstruct vascular maps plotted as normalized power doppler signal overlaid on anatomical images in grayscale. White arrows indicate location of vasculature around the tumor and not in the core of the tumor as seen by Doppler ultrasound. Scale bars represent 1 mm.
Figure 21:
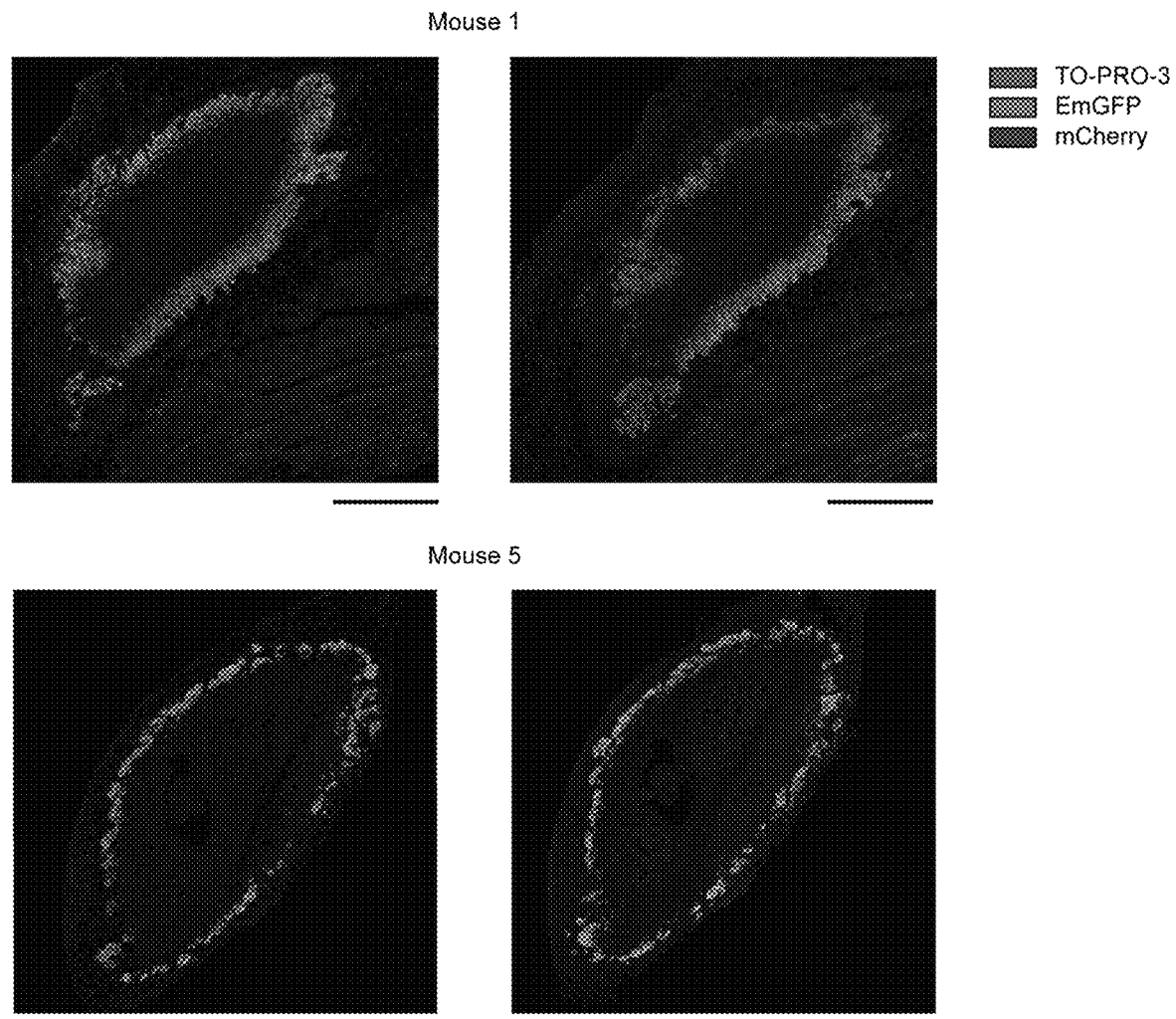
FIG. 21 shows representative histology sections of tumors containing mARG-HEK cells. For each mouse, two neighboring sections are presented. The light gray color shows the GFP and mCherry fluorescence around the periphery of the tumor.
Figure 22:
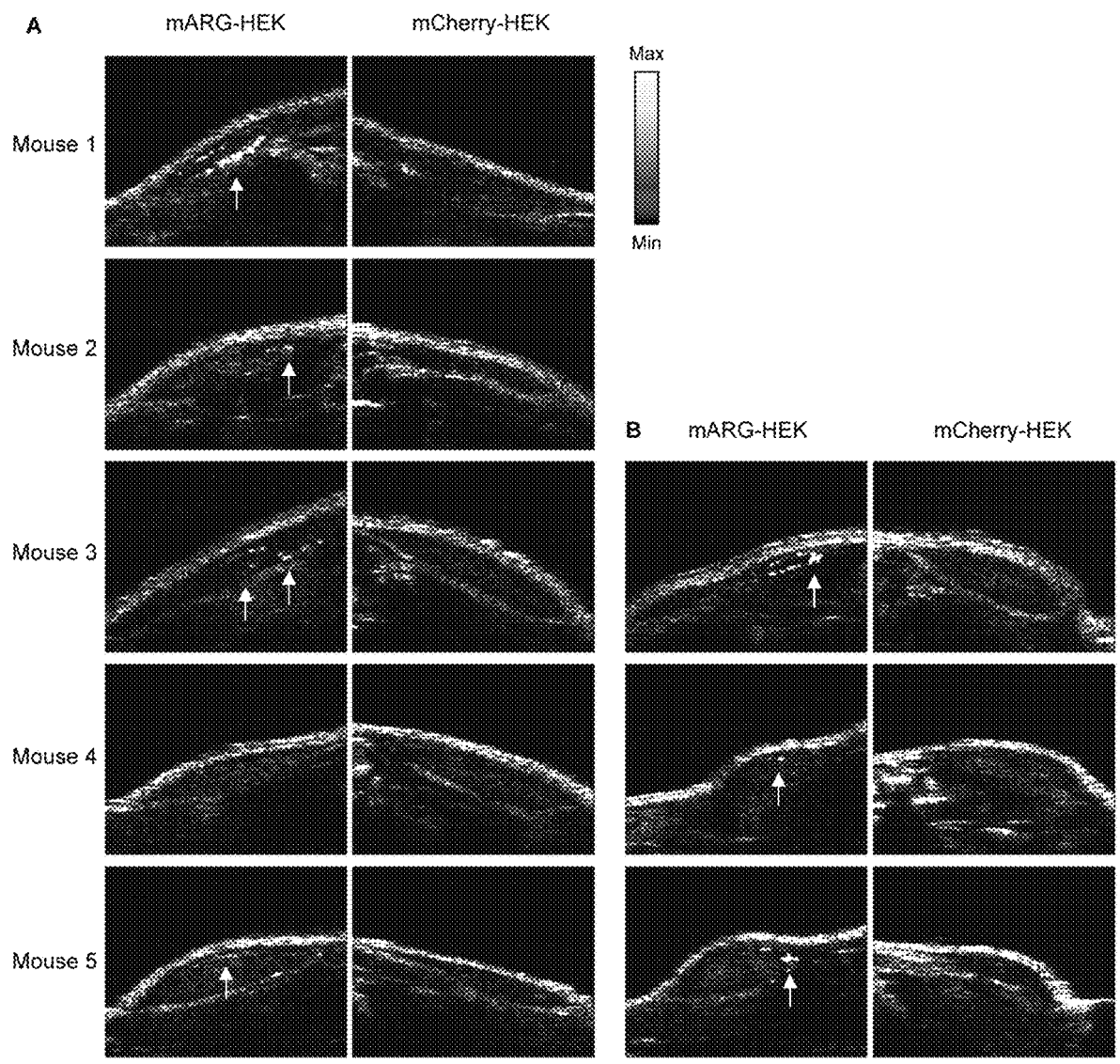
FIG. 22 shows biological replicates of in vivo ultrasound imaging of gene expression. In particular, in FIG. 22 Panel A, the left column shows ultrasound images of tumors containing mARG-HEK cells after 4 days of doxycycline administration. The right column shows ultrasound images of tumors containing mCherry-HEK cells after 4 days of doxycycline administration. After imaging the tumors were insonated with 3.2 MPa of ultrasound to collapse the expressed gas vesicles.

Interestingly, fluorescence imaging indicated that both tumors were receiving the inducer doxycycline (FIG. 15, panel G) but it appears as though the entire tumor was equally expressing the reporter genes. However, using ultrasound only a 'zone' of gas vesicles-specific contrast was observed. Using doppler ultrasound, a technique used to visualize the vasculature, it was observed that inside the tumor was avascular as expected from the short period post inoculation (FIG. 20). After the tumors were sectioned and imaged using fluorescent histology (FIG. 15, panel F and FIG. 21), it became evident that the diffusion of inducer to the tumor cells painted a band of gene expression. This pattern of gene expression was non-invasively visualized with ultrasound using mARGs, whereas fluorescent imaging could not reveal this expression pattern due to the limited penetration of light in tissue. BURST ultrasound imaging of adjacent planes could be collected to non-invasively image gene expression across the tumor (FIG. 15, panel E and FIG. 19). Furthermore, similar to the in vitro experiments, mARG-expressing cells can repeatedly express gas vesicles, imaged and re-express gas vesicles to enable repeated monitoring cellular location and function (FIG. 22B).

Example 20: Ultrasound Contrast in View of GV Concentration in Mammalian Cells In Vitro A further set of experiments was performed to test the dependence of ultrasound contrast on gas vesicle density in mammalian cell culture. In particular, a monoculture of mARG-HEK cells was induced with different concentrations of doxycycline, or after fully-induced mARG-HEK cells were mixed with mCherry-HEK cells at different ratios. All cells were cultured with 5 mM sodium butyrate during expression. After that relative ultrasound contrast produced by mARG-HEK cells was tested in hydrogel as a function of the estimated average number of gas vesicles (GV) per nanoliter present. The number of gas vesicles was quantified after 72 hours of induced expression, as counted in lysates using TEM. Ultrasound contrast was normalized to the maximum in each type of titration.

Figure 18:
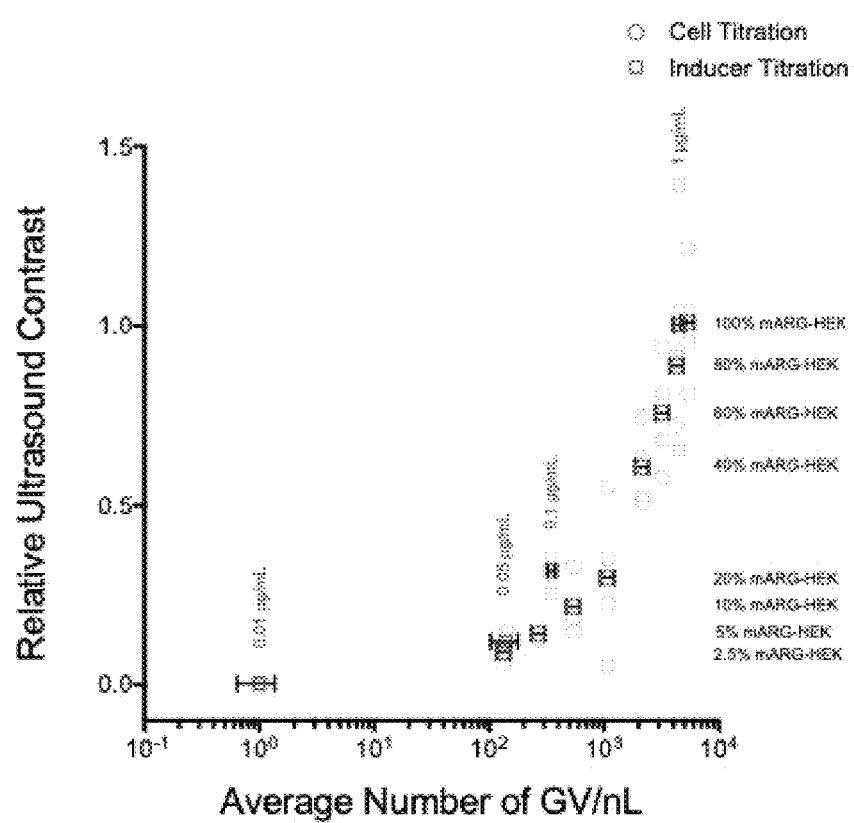
FIG. 18 shows a chart illustrating a relative ultrasound contrast produced by mARG-HEK cells in hydrogel as a function of the estimated average number of gas vesicles (GV) per nanoliter gray circle symbols represent results from mARG-HEK cells induced with 1 µg/mL doxycycline for 3 days (producing on average 45 gas vesicles per cell) mixed with mCherry-HEK cells (expressing no gas vesicles) in varying proportions, as presented in FIG. 14 Panel H. Square Gray symbols represent results from mARG-HEK cells induced with 0.01, 0.05, 0.1 and 1 µg/mL doxycycline for 3 days; expressing on average 0.01±0.004, 1.4±0.4, 3.5±0.3, 45±5.1 (mean±SEM) gas vesicles per cell, respectively, as quantified by TEM . . . Dark symbols show the mean of ultrasound contrast for 4 replicates. Error bars represent SEM of 4 biological replicates for 0.01, 0.05, 0.1 µg/mL induction and n=3 biological replicates (each from two technical replicates) for 1 µg/mL samples.

In particular the ultrasound contrast mARG-HEK cells induced with 1 μg/mL doxycycline for 3 days (producing on average 45 gas vesicles per cell) mixed with mCherry-HEK cells (expressing no gas vesicles) in varying proportions is reported in FIG. 18 with light gray symbols.

The ultrasound contrast of mARG-HEK cells induced with 0.01, 0.05, 0.1 and 1 μg/mL doxycycline for 3 days; expressing on average 0.01±0.004, 1.4±0.4, 3.5±0.3, 45±5.1 (mean±SEM) gas vesicles per cell, respectively, as quantified by TEM is reported in FIG. 18 with dark gray symbols.

From this study, illustrated in FIG. 18, the applicants can conclude to detect the presence of mARG-expressing cells in these mixtures down to 2.5% of total cells, corresponding to <0.5% volumetric density, or about three cells or 135 gas vesicles per voxel with dimensions of 100 mm. A similar voxel-averaged concentration of gas vesicles was detectable in a monoculture of mARG-HEK cells induced to express 1.4±0.6 gas vesicles per cell.

Example 21: Selection Funnel for GVES Transfected n Mammalian Cells In Vitro

GVES can be integrated in the genome of mammalian cells, e.g. Example 13. Genomic integration methods described above and known by a skilled person will produce a heterogeneous polyclonal population of cells. In this heterogeneous population of cells, there will be a range of GVES expression levels from high expression down to no detectable expression.

The polyclonal population of mammalian cells will produce gas vesicles as illustrated in FIG. 11. Using cell sorting methods such as FACS and/or magnetic assisted cell sorting (MACS), the cells can be binned into groups of cells with similar expression profiles, as exemplified in (FIG. 11, panel B) or monoclonal cells can be selected (FIG. 12, panel C and D). Monoclonal cells are a colony of cells that have been expanded from a single parent cell.

The applicant selected 575 monoclonal cells using FACS from polyclonal HEK-tetON cells that using the piggyBac transposase system, had Example 13 GVES integrated in their genome. From these cells, the best performing monoclonal cells were assayed by measuring cellular viability, fluorescence intensity, and gas vesicle expression as measured by TEM for each cell after expression for 72 hours (upon induction with 1 μg/mL of doxycycline and 5 mM sodium butyrate (Table 19).

TABLE 19 selection funnel for mARG-HEK cells

| Collected from FACS | Formed colonies | Triple positive fluorescence | Formed GVs (TEM) | >1 GVs/cell |
|---|---|---|---|---|
| 576 | 30 | 21 | 12 | 6 |

The numbers indicate the number of cells or cell lines selected at each stage. From this experiment, the best performing cells produced on average 45 gas vesicles per cell (FIG. 13, panel E).

Example 22: Exemplary GVGC Polynucleotide Construct to Allow Expression of Two Different GV Cassettes Experiments were performed to identify elements that can be used to create configurations of a construct designed to allow expression of two different GV cassettes.

Figure 23:
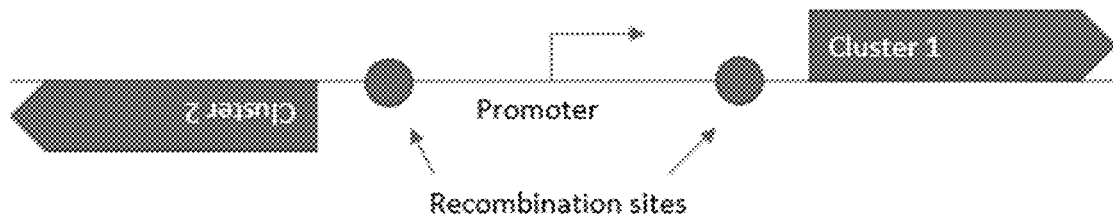
FIG. 23 shows an exemplary configuration of a construct designed to allow expression of two different GV types in one prokaryotic cell.

An element that can be used in constructs of the present disclosure is exemplified in the exemplary construct in FIG. 23 designed to provide alternating expression of two GV types in a prokaryotic cell and/or mammalian cell, the first GV type encoded by Cluster 1, and the second GV type encoded by Cluster 2, shown as block-shaped arrows facing in opposite orientations of a DNA strand (shown as a straight line), with a promoter between the two clusters. The promoter is flanked by recombination sites (e.g. flippase recognition target, FRT sites) shown as circles. For example, initially, the promoter can be oriented in a direction operatively linked to Cluster 1, initiating expression of gvp genes for the formation of GV type 1.

In presence of a cognate recombinase (e.g. flippase, Flp, CRE/Lox), expressed from another genetic construct in the mammalian cell, the orientation of the promoter is reversed upon recombination at the FRT sites, and thereafter is oriented in the opposite direction, operatively linked to Cluster 2, initiating expression of gvp genes for the formation of GV type 2.

The use of recombination sites can alternatively control the conditional expression of a transactivating or repressing protein element that control the activity of GVES promoter(s). The recombination site, flanking a promoter that controls the expression of the transcription regulatory factor (e.g. TET) can be switched in an orientation that can express the transactivating or repressing protein element, or can switch to the opposite direction so that transcription regulatory factor is no longer expressed. As a result, the activity of the GVES promoter can be tuned.

Example 23: Construction of Consolidated Optimized GVES System

Experiments were performed to verify whether the architecture of the mARG of Example 13 can be further consolidated by connecting the gas vesicle protein B gene to the polycistronic construct using IRES. When this architecture is co-transfected to cells with the booster plasmid, it robustly produces gas vesicles. This strategy is being further pursued to consolidate the mammalian ARG to a single genetic cassette.

In particular, a consolidated mARG construct comprising 2 gene cassettes enabling mammalian gas vesicle expression has been identified following the Experiments reporting in FIGS. 24A-24D.

The construct encoding gvpB from *B. megaterium* of Table 15 was combined with the construct in Table 16 using an IRES sequence. A schematic illustrates this in FIG. 24A (top) and Table 20 indicates the gene sequence.

Figure 24A:
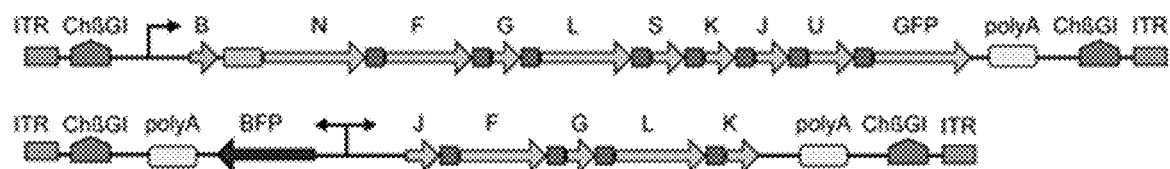
FIGS. 24A-24D illustrate an consolidated mARG construct comprising 2 gene cassettes enabling mammalian gas vesicle expression.
Figure 24B:
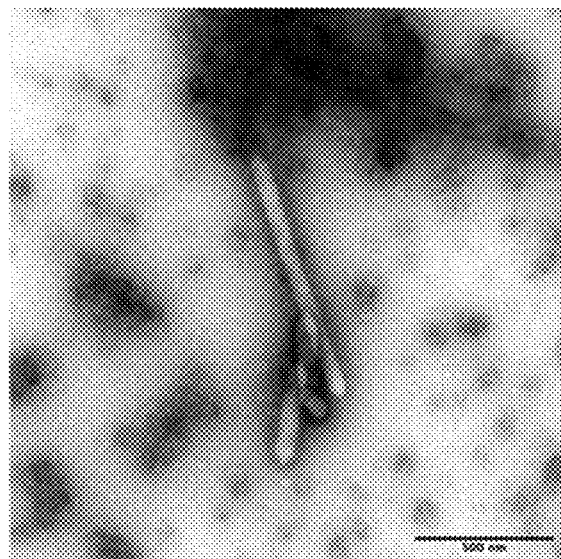
Figure 24C:
Figure 24D:
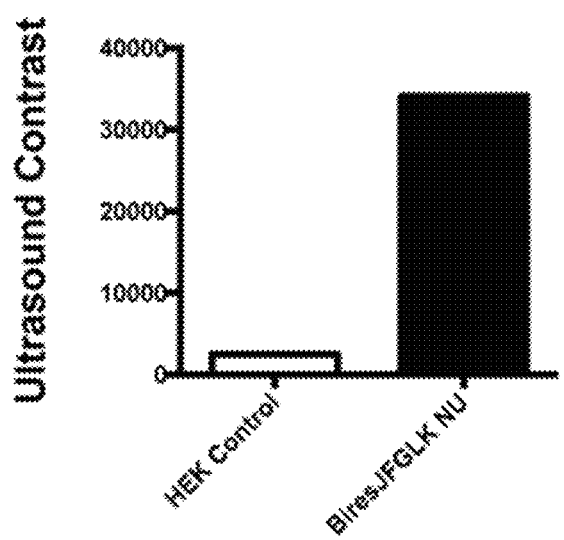

The cassette from Table 20 and table 17 were integrated to the genome of HEK293-tetON cells as reported the material and methods. GV expression in these cells was detectable using TEM of the cell lysate after 72 hours of expression with 1 μg/mL doxycycline (FIG. 24B).

Similarly, the construct encoding gvpB from *B. megaterium* of Table 11 was combined with the construct in Table 14 using an IRES sequence. A schematic illustrates this in FIG. 24C (top) and Table 21 indicates the gene sequence. The cassette from Table 21 and table 12 were transiently transfected to the genome of HEK293T cells as reported the material and methods. GV expression in these cells was detectable using BURST ultrasound imaging of the cells after 72 hours of expression (FIG. 24D), HEK control refers to wild types HEK293T cells and BiresJFGLK NU refers to HEK293T cells that have been transfected with constructs in Table 21 and Table 12.

TABLE 20

Exemplary consolidated polynucleotide cassette for polycistronic expression of gvpB with GVA proteins.

| Construct | Sequence | seq id no: |
|---|---|---|
| CMV: gvpB: IRES: gvpNFGES KJU- EmGFP: polyA | CGTTACATAACTTACGGTAAATGGCCCGCCTGGCTGACCGCCCAACGACC CCCGCCCATTGACGTCAATAATGACGTATGTTCCCATAGTAACGCCAATA GGGACTTTCCATTGACGTCAATGGGTGGAGTATTTACGGTAAACTGCCCA CTTGGCAGTACATCAAGTGTATCATATGCCAAGTACGCCCCCTATTGACG TCAATGACGGTAAATGGCCCGCCTGGCATTATGCCCAGTACATGACCTTA TGGGACTTTCCTACTTGGCAGTACATCTACGTATTAGTCATCGCTATTACC ATGGTGATGCGGTTTTGGCAGTACATCAATGGGCGTGGATAGCGGTTTGA CTCACGGGGATTTCCAAGTCTCCACCCCATTGACGTCAATGGGAGTTTGTT TTGGCACCAAAATCAACGGGACTTTCCAAAATGTCGTAACAACTCCGCCC CATTGACGCAAATGGGCGGTAGGCGTGTACGGTGGGAGGTCTATATAAGC AGAGCTCGTTTAGTGAACCGTCAGATCGCCTGGAGACGCCATCCACGCTG TTTTGACCTCCATAGAAGACACCGGGACCGATCCAGCCTCCGGACTCTAG CCTAGGCTTTTGCAAAAAGCTATTTAGGTGACACTATAGAAGGTACGCCT GCAGGTACCGAGCTCGGATCCAGTACCCTTCACCATGAGCATCCAGAAGT CCACCAACAGCAGCAGCCTGGCCGAAGTGATCGACCGGATCCTGGACAA GGGCATCGTGATCGACGCCTTCGCCAGAGTGTCCGTCGTGGGCATCGAGA TCCTGACCATCGAGGCCAGAGTCGTGATCGCCAGCGTGGACACCTGGCTG AGATATGCCGAAGCCGTGGGCCTGCTGCGGGACGACGTGGAAGAAATG GCCTGCCCGAGCGGAGCAACAGCTCTGAGGGACAGCCCCGGTTCAGCATC TGAACTAAATCGCACTGTCGGCGTCCCCCCCTAACGTTACTGGCCGAAGC CGCTTGGAATAAGGCCGGTGTGCGTTTGTCTATATGTTATTTTCCACCATA TTGCCGTCTTTTGGCAATGTGAGGGCCCGGAAACCTGGCCCTGTCTTCTTG ACGAGCATTCCTAGGGGTCTTTCCCCTCTCGCCAAAGGAATGCAAGGTCT GTTGAATGTCGTGAAGGAAGCAGTTCCTCTGGAAGCTTCTTGAAGACAAA CAACGTCTGTAGCGACCCTTTGCAGGCAGCGGAACCCCCCACCTGGCGAC AGGTGCCTCTGCGGCCAAAAGCCACGTGTATAAGATACACCTGCAAAGGC GGCACAACCCCAGTGCCACGTTGTGAGTTGGATAGTTGTGGAAAGAGTCA AATGGCTCTCCTCAAGCGTATTCAACAAGGGGCTGAAGGATGCCCAGAAG GTACCCCATTGTATGGGATCTGATCTGGGGCCTCGGTGCACATGCTTTACA TGTGTTTAGTCGAGGTTAAAAAACGTCTAGGCCCCCCGAACCACGGGGAC GTGGTTTTCCTTTGAAAAACACGATGATAATATGGCCACAACCGTGACCG TGCTGACCGACAAGCGGAAGAAGGGCAGCGGCGCCTTCATCCAGGACGA CGAGACAAAAGAGGTGCTGAGCAGAGCCCTGAGCTACCTGAAGTCCGGC TACAGCATCCACTTCACCGGACCTGCCGGCGGAGGCAAGACATCTCTGGC TAGAGCCCTGGCCAAGAAACGGAAGCGGCCCGTGATGCTGATGCACGGC AACCACGAGCTGAACAACAAGGACCTGATCGGCGATTTCACCGGCTACAC CAGCAAAAAGGTGATCGACCAGTACGTGCGGAGCGTGTACAAGAAAGAC GAACAGGTGTCCGAGAACTGGCAGGACGGCAGACTGCTGGAAGCCGTGA AGAATGGCTACACCCTGATCTACGACGAGTTCACCAGAAGCAAGCCCGCT ACCAACAACATCTTCCTGAGCATCCTTGAGGAGGGCGTGCTGCCCCTGTA CGGCGTGAAGATGACCGACCCTTTCGTGCGCGTGCACCCCGACTTCAGAG TGATCTTTACCAGCAACCCCGCCGAGTATGCCGGCGTGTACGATACCCAG GACGCCCTGCTGGACCGGCTGATCACCATGTTCATCGACTACAAGGACAT CGACCGGGAAACCGCTATCCTGACCGAGAAAACTGACGTGGAAGAAGAC GAGGCCCGGACCATCGTGACCCTGGTGGCCAACGTGCGGAACAGAAGCG GCGACGAGAATAGCAGCGGCCTGAGCCTGAGAGCCAGCCTGATGATTGC CACCCTGGCCACCCAGCAGGACATCCCTATCGATGGCAGCGACGAGGACT TCCAGACCCTGTGCATCGACATCCTGCACCACCCCCTGACCAAGTGCCTG GACGAAGAGAACGCCAAGAGCAAGGCCGAGAAGATCATTCTCGAAGAGT GCAAGAACATCGACACCGAGGAGAAGGGTGCCCCGGGATCTGGCGCAAC AAATTTTAGTCTTTTAAAGCAGGCAGGAGACGTCGAGGAAAACCCTGGAC CCGTGAGCGAGACAAACGAGACAGGCATCTACATCTTCAGCGCCATCCAG ACAGACAAGGATGAGGAATTCGGCGCCGTGGAAGTGGAAGGGACCAAGG CTGAGACATTCCTGATCCGGTATAAGGACGCCGCCATGGTGGCCGCCGAA GTGCCCATGAAGATCTACCACCCCAACCGGCAGAACCTGCTGATGCACCA GAATGCCGTGGCCGCCATCATGGACAAGAACGACACCGTGATCCCCATCA GCTTCGGCAACGTGTTCAAGAGCAAAGAGGACGTGAAGGTGCTCCTGGA AAACCTGTACCCCCAGTTCGAGAAGCTGTTCCCCGCCATCAAGGGAAAGA TCGAAGTGGGCCTGAAGGTGATCGGCAAGAAAGAGTGGCTCGAAAAGAA AGTGAACGAGAACCCCGAGCTGGAAAAAGTGTCCGCCAGCGTGAAGGGC AAGAGCGAGGCCGCTGGCTACTACGAGAGAATCCAGCTGGGCGGCATGG CCCAGAAGATGTTCACAAGCCTGCAGAAAGAAGTGAAAACCGACGTGTT CAGCCCCCTGGAAGAAGCCGCCGAGGCCGCCAAAGCCAATGAGCCTACA GGCGAAACAATGCTGCTGAACGCCAGCTTCCTGATCAACAGAGAGGATG AGGCCAAGTTCGACGAGAAAGTCAATGAGGCCCACGAGAACTGGAAGGA TAAGGCCGACTTCCACTACAGCGGCCCCTGGCCCGCCTACAACTTCGTGA | 454 |

TABLE 20-continued

Exemplary consolidated polynucleotide cassette for polycistronic expression of gvpB with GVA proteins.

| Construct | Sequence | seq id no: |
|---|---|---|
| | ACATCCGGCTGAAGGTGGAAGAGAAGGGGGCACCTGGCTCGGGAGCGAC<br>CAACTTCTCATTACTCAAACAAGCCGGAGACGTTGAGGAGAATCCAGGCC<br>CTGTGCTGCACAAGCTCGTGACCGCCCCCATCAACCTGGTCGTGAAGATC<br>GGCGAGAAGGTGCAGGAAGAGGCCGACAAGCAGCTGTACGACCTGCCCA<br>CCATCCAGCAGAAGCTGATCCAGCTGCAGATGATGTTCGAGCTGGGCGAG<br>ATCCCCGAGGAAGCCTTCCAGGAAAAAGAGGACGAACTGCTGATGAGAT<br>ACGAGATCGCCAAGCGGCGCGAGATTGAGCAGTGGGAAGAACTGACCCA<br>GAAGCGGAATGAGGAAAGCGGTGCCCCGGGATCTGGCGCAACAAATTTT<br>AGTCTTTTAAAGCAGGCAGGAGACGTCGAGGAAAACCCTGGACCCGTGG<br>GCGAGCTGCTGTACCTCTACGGCCTGATCCCCACCAAAGAGGCCGCTGCT<br>ATCGAGCCCTTCCCATTCTACAAGGGCTTCGACGGCGAGCACAGCCTGTA<br>CCCTATCGCCTTCGACCAAGTGACCGCCGTGGTGTTCAAGCTGGACGCCG<br>ACACCTACAGCGAGAAAGTGATCCAGGAAAAGATGGAACAGGACATGAG<br>CTGGCTGCAGGAAAAGGCCTTCCACCACCACGAGACAGTGGCCGCCCTGT<br>ATGAGGAATTCACCATCATCCCCCTGAAGTTCTGCACCATCTATAAGGGA<br>GAGGAATCCCTGCAGGCCGCCATCGAGATCAACAAAGAGAAGATCGAAA<br>ACTCCCTGACCCTGCTGCAGGGCAACGAGGAATGGAACGTGAAGATCTAC<br>TGCGACGACACCGAGCTGAAGAAGGGCATCAGCGAGACAAACGAGAGCG<br>TGAAGGCCAAGAAGCAGGAAATCAGCCACCTGAGCCCCGGCAGACAGTT<br>CTTCGAGAAGAAGAAGATTGACCAGCTCATCGAGAAAGAGCTGGAACTG<br>CACAAGAACAAAGTGTGCGAGGAAATCCACGACAAGCTGATTGAGCTGA<br>GCCTCTACGACTCCGTGAAGAAGAACTGGTCCAAGGACGTGACAGGCGCT<br>GCCGAACAGATGGCCTGGAACAGCGTGTTCCTGCTGCCCAGCCTGCAGAT<br>CACCAAGTTCGTGAACGAGATCGAGGAACTCCAGCAGCGGCTGGAGAAC<br>AAGGGATGGAAGTTCGAAGTGACCGGCCCCTGGCCTCCCTACCACTTCAG<br>CAGCTTTGCCGGGGCACCTGGCTCGGGAGCGACCAACTTCTCATTACTCA<br>AACAAGCCGGAGACGTTGAGGAGAATCCAGGCCCTGTGAGCCTGAAGCA<br>GAGCATGGAGAATAAGGATATCGCCCTGATCGACATCCTCGACGTGATCC<br>TGGACAAGGGAGTGGCCATCAAGGGCGACCTGATCATCTCTATCGCCGGC<br>GTGGACCTGGTGTACCTGGATCTGAGAGTGCTGATCTCCAGCGTGGAAAC<br>CCTGGTGCAGGCCAAAGAGGGCAACCACAAGCCCATCACCAGCGAGCAG<br>TTCGACAAGCAGAAAGAGGAGCTGATGGACGCCACCGGCCAGCCCAGCA<br>AGTGGACAAATCCTCTGGGCAGCGGCGCTCCCGGGTCAGGTGCCACGAAT<br>TTTTCGTTGTTGAAGCAAGCTGGGGATGTTGAAGAGAACCCAGGGCCTGT<br>GCAGCCCGTGTCCCAGGCCAACGGCAGAATCCACCTGGATCCCGATCAGG<br>CCGAACAGGGACTGGCCCAGCTCGTGATGACCGTGATCGAGCTGCTGCGG<br>CAGATCGTGAACGGACACGCCATGAGAAGAGTGGAAGGCGGCACCCTGA<br>CCGACGAGCAGATCGAGAATCTGGGAATCGCTCTGATGAACCTGGAGGA<br>GAAGATGGACGAGCTGAAAGAGGTGTTCGGACTGGACGCTGAGGATCTG<br>AACATCGACCTGGGCCCTCTGGGCAGCCTGCTGGGTGCCCCGGGATCTGG<br>CGCAACAAATTTTAGTCTTTTAAAGCAGGCAGGAGACGTCGAGGAAAACC<br>CTGGACCCGTGGCCGTGGAACACAACATGCAGAGCAGCACCATCGTGGA<br>CGTGCTGGAAAAGATCCTGGACAAGGGCGTCGTGATCGCCGGGGACATC<br>ACAGTGGGAATCGCCGACGTGGAACTGCTGACCATCAAGATCCGGCTGAT<br>CGTGGCCAGCGTGGACAAGGCCAAAGAAATCGGCATGGATTGGTGGGAG<br>AACGACCCCTACCTGAGCAGCAAGGGCGCCAACAACAAGGCTCTGGAAG<br>AGGAAAACAAGATGCTGCACGAGCGGCTGAAAACACTGGAAGAGAAGAT<br>CGAGACAAAGCGCGGGGCACCTGGCTCGGGAGCGACCAACTTCTCATTAC<br>TCAAACAAGCCGGAGACGTTGAGGAGAATCCAGGCCCTGTGAGCACCGG<br>CCCCAGCTTCAGCACCAAGGACAACACCCTGGAATACTTCGTGAAGGCCA<br>GCAACAAGCACGGCTTTAGCCTCGACATCAGCCTGAACGTGAATGGGGCC<br>GTGATTAGCGGCACCATGATCAGCGCCAAAGAGTACTTCGACTACCTGAG<br>CGAGACATTCGAAGAGGGCAGCGAAGTGGCCCAGGCCCTGTCTGAGCAG<br>TTTAGCCTGGCTAGCGAGGCCTCCGAGTCTAATGGCGAAGCCGAGGCCCA<br>CTTCATCCACCTGAAGAACACCAAGATCTACTGCGGCGACAGCAAGAGCA<br>CCCCCAGCAAGGGCAAGATCTTCTGGCGCGGCAAGATCGCCGAGGTGGA<br>CGGATTCTTCCTGGGAAAAATCAGCGACGCCAAGTCCACCAGCAAGAAGT<br>CCAGCGGCGCTCCCGGGTCAGGTGCCACGAATTTTTCGTTGTTGAAGCAA<br>GCTGGGGATGTTGAAGAGAACCCAGGGCCTGTGGTGTCCAAGGGCGAGG<br>AACTGTTCACCGGCGTGGTGCCCATCCTGGTGGAACTGGATGGCGACGTG<br>AACGGCCACAAGTTCAGCGTGTCCGGCGAGGGCGAAGGCGACGCCACAT<br>ACGGAAAGCTGACCCTGAAGTTCATCTGCACCACCGGCAAGCTGCCCGTG<br>CCTTGGCCTACCCTCGTGACCACACTGACCTACGGCGTGCAGTGCTTCGCC<br>AGATACCCCGACCACATGAAGCAGCACGATTTCTTCAAGAGCGCCATGCC<br>CGAGGGCTACGTGCAGGAACGGACCATCTTCTTCAAGGACGACGGCAACT<br>ACAAGACAAGAGCCGAAGTGAAGTTCGAGGGCGACACCCTCGTGAACCG<br>GATCGAGCTGAAGGGCATCGACTTCAAAGAGGATGGCAACATCCTGGGC<br>CACAAGCTGGAGTACAACTACAACAGCCACAAGGTGTACATCACCGCCG<br>ACAAGCAGAAAAACGGCATCAAAGTGAACTTCAAGACCCGGCACAACAT<br>CGAGGACGGCAGCGTGCAGCTGGCCGACCACTACCAGCAGAACACCCCC<br>ATCGGAGATGGCCCCGTGCTGCTGCCCGACAACCACTACCTGAGCACACA<br>AAGCGCCCTGAGCAAGGACCCCAACGAGAAGCGGGACCACATGGTGCTG<br>CTGGAATTTGTGACCGCCGCTGGCATCACCCTGGGCATGGACGAGCTGTA<br>CAAGTGACTCGAGTCTAGAGGGCCCCGTGGCTGTAATCTAGAGGATCCCT | |

TABLE 20-continued

Exemplary consolidated polynucleotide cassette for polycistronic expression of gvpB with GVA proteins.

| Construct | Sequence | seq id no: |
|---|---|---|
| | CGAGGGGCCCAAGCTTACGCGTGCATGCGACGTCATAGCTCTCTCCCTAT<br>AGTGAGTCGTATTATAAGCTAGCTTGGGATCTTTGTGAAGGAACCTTACTT<br>CTGTGGTGTGACATAATTGGACAAACTACCTACAGAGATTTAAAGCTCTA<br>AGGTAAATATAAAATTTTTAAGTGTATAATGTGTTAAACTAGCTGCATAT<br>GCTTGCTGCTTGAGAGTTTTGCTTACTGAGTATGATTTATGAAAATATTAT<br>ACACAGGAGCTAGTGATTCTAATTGTTTGTGTATTTTAGATTCACAGTCCC<br>AAGGCTCATTTCAGGCCCCTCAGTCCTCACAGTCTGTTCATGATCATAATC<br>AGCCATACCACATTTGTAGAGGTTTTACTTGCTTTAAAAAACCTCCCACAC<br>CTCCCCCTGAACCTGAAACATAAAATGAATGCAATTGTTGTTGTTAACTTG<br>TTTATTGCAGCTTATAATGGTTACAAATAAAGCAATAGCATCACAAATTT<br>CACAAATAAAGCATTTTTTTCACTGCATTCTAGTTGTGGTTTGTCCAAACT<br>CATCAATGTATCTTATCATGTCTGGATC | |

TABLE 21

Alternative exemplary consolidated polynucleotide cassette for polycistronic expression of gvpB with GVA proteins.

| Construct | Sequence | seq id no: |
|---|---|---|
| CMV: gvpB:<br>IRES:<br>gvpJFGLK:<br>polyA | CGTTACATAACTTACGGTAAATGGCCCGCCTGGCTGACCGCCCAACGACC<br>CCCGCCCATTGACGTCAATAATGACGTATGTTCCCATAGTAACGCCAATA<br>GGGACTTTCCATTGACGTCAATGGGTGGAGTATTTACGGTAAACTGCCCA<br>CTTGGCAGTACATCAAGTGTATCATATGCCAAGTACGCCCCCTATTGACG<br>TCAATGACGGTAAATGGCCCGCCTGGCATTATGCCCAGTACATGACCTTA<br>TGGGACTTTCCTACTTGGCAGTACATCTACGTATTAGTCATCGCTATTACC<br>ATGGTGATGCGGTTTTGGCAGTACATCAATGGGCGTGGATAGCGGTTTGA<br>CTCACGGGGATTTCCAAGTCTCCACCCCATTGACGTCAATGGGAGTTTGTT<br>TTGGCACCAAAATCAACGGGACTTTCCAAAATGTCGTAACAACTCCGCCC<br>CATTGACGCAAATGGGCGGTAGGCGTGTACGGTGGGAGGTCTATATAAGC<br>AGAGCTCGTTTAGTGAACCGTCAGATCGCCTGGAGACGCCATCCACGCTG<br>TTTTGACCTCCATAGAAGACACCGGGACCGATCCAGCCTCCGGACTCTAG<br>CCTAGGCTTTTGCAAAAAGCTATTTAGGTGACACTATAGAAGGTACGCCT<br>GCAGGTACCGAGCTCGGATCCAGTACCCTTCACCATGAGCATCCAGAAGT<br>CCACCAACAGCAGCAGCCTGGCCGAAGTGATCGACCGGATCCTGGACAA<br>GGGCATCGTGATCGACGCCTTCGCCAGAGTGTCCGTCGTGGGCATCGAGA<br>TCCTGACCATCGAGGCCAGAGTCGTGATCGCCAGCGTGGACACCTGGCTG<br>AGATATGCCGAAGCCGTGGGCCTGCTGCGGGACGACGTGGAAGAAATG<br>GCCTGCCCGAGCGGAGCAACAGCTCTGAGGGACAGCCCCGGTTCAGCATC<br>TGAACTAAATCGCACTGTCGGCGTCCCCCCCTAACGTTACTGGCCGAAGC<br>CGCTTGGAATAAGGCCGGTGTGCGTTTGTCTATATGTTATTTTCCACCATA<br>TTGCCGTCTTTTGGCAATGTGAGGGCCCGGAAACCTGGCCCTGTCTTCTTG<br>ACGAGCATTCCTAGGGGTCTTTCCCCTCTCGCCAAAGGAATGCAAGGTCT<br>GTTGAATGTCGTGAAGGAAGCAGTTCCTCTGGAAGCTTCTTGAAGACAAA<br>CAACGTCTGTAGCGACCCCTTTGCAGGCAGCGGAACCCCCCACCTGGCGAC<br>AGGTGCCTCTGCGGCCAAAAGCCACGTGTATAAGATACACCTGCAAAGGC<br>GGCACAACCCCAGTGCCACGTTGTGAGTTGGATAGTTGTGGAAAGAGTCA<br>AATGGCTCTCCTCAAGCGTATTCAACAAGGGGCTGAAGGATGCCCAGAAG<br>GTACCCCATTGTATGGGATCTGATCTGGGGCCTCGGTGCACATGCTTTACA<br>TGTGTTTAGTCGAGGTTAAAAAACGTCTAGGCCCCCCGAACCACGGGGAC<br>GTGGTTTTCCTTTGAAAAACACGATGATAATATGGCCACAACCGTGGCCG<br>TGGAACACAACATGCAGAGCAGCACCATCGTGGACGTGCTGGAAAAGAT<br>CCTGGACAAGGGCGTCGTGATCGCCGGGGACATCACAGTGGGAATCGCC<br>GACGTGGAACTGCTGACCATCAAGATCCGGCTGATCGTGGCCAGCGTGGA<br>CAAGGCCAAAGAAATCGGCATGGATTGGTGGGAGAACGACCCCTACCTG<br>AGCAGCAAGGGCGCCAACAACAAGGCCCTGGAAGAGGAAAACAAGATG<br>CTGCACGAGCGGCTGAAAAACACTGGAAGAGAAGATCGAGACAAAGCGCG<br>GTGCCCCGGGATCTGGCGCAACAAATTTTAGTCTTTTAAAGCAGGCAGGA<br>GACGTCGAGGAAAACCCTGGACCCGTGAGCGAGACAAACGAGACAGGCA<br>TCTACATCTTCAGCGCCATCCAGACAGACAAGGATGAGGAATTCGGCGCC<br>GTGGAAGTGGAAGGGACCAAGGCTGAGACATTCCTGATCCGGTATAAGG<br>ACGCCGCCATGGTGGCCGCCGAAGTGCCCATGAAGATCTACCACCCCAAC<br>CGGCAGAACCTGCTGATGCACCAGAATGCCGTGGCCGCCATCATGGACAA<br>GAACGACACCGTGATCCCCATCAGCTTCGGCAACGTGTTCAAGAGCAAAG<br>AGGACGTGAAGGTGCTCCTGGAAAACCTGTACCCCCAGTTCGAGAAGCTG<br>TTCCCCGCCATCAAGGGAAAGATCGAAGTGGGCCTGAAGGTGATCGGCA<br>AGAAAGAGTGGCTCGAAAAGAAAGTGAACGAGAACCCCGAGCTGGAAA<br>AAGTGTCCGCCAGCGTGAAGGGCAAGAGCGAGGCCGCTGGCTACTACGA<br>GAGAATCCAGCTGGGCGGCATGGCCCAGAAGATGTTCACAAGCCTGCAG<br>AAAGAAGTGAAAACCGACGTGTTCAGCCCCCTGGAAGAAGCCGCCGAGG | 455 |

TABLE 21-continued

Alternative exemplary consolidated polynucleotide cassette for polycistronic expression of gvpB with GVA proteins.

| Construct | Sequence | seq id no: |
|---|---|---|
| | CCGCCAAAGCCAATGAGCCTACAGGCGAAACAATGCTGCTGAACGCCAG | |
| | CTTCCTGATCAACAGAGAGGATGAGGCCAAGTTCGACGAGAAAGTCAAT | |
| | GAGGCCCACGAGAACTGGAAGGATAAGGCCGACTTCCACTACAGCGGCC | |
| | CCTGGCCCGCCTACAACTTCGTGAACATCCGGCTGAAGGTGGAAGAGAAG | |
| | GGGGCACCTGGCTCGGGAGCGACCAACTTCTCATTACTCAAACAAGCCGG | |
| | AGACGTTGAGGAGAATCCAGGCCCTGTGCTGCACAAGCTCGTGACCGCCC | |
| | CCATCAACCTGGTCGTGAAGATCGGCGAGAAGGTGCAGGAAGAGGCCGA | |
| | CAAGCAGCTGTACGACCTGCCCACCATCCAGCAGAAGCTGATCCAGCTGC | |
| | AGATGATGTTCGAGCTGGGCGAGATCCCCGAGGAAGCCTTCCAGGAAAA | |
| | AGAGGACGAACTGCTGATGAGATACGAGATCGCCAAGCGGCGCGAGATT | |
| | GAGCAGTGGGAAGAACTGACCCAGAAGCGGAATGAGGAAAGCGGTGCCC | |
| | CGGGATCTGGCGCAACAAATTTTAGTCTTTTAAAGCAGGCAGGAGACGTC | |
| | GAGGAAAACCCTGGACCCGTGGGCGAGCTGCTGTACCTCTACGGCCTGAT | |
| | CCCCACCAAAGAGGCCGCTGCTATCGAGCCCTTCCCATTCTACAAGGGCT | |
| | TCGACGGCGAGCACAGCCTGTACCCTATCGCCTTCGACCAAGTGACCGCC | |
| | GTGGTGTTCAAGCTGGACGCCGACACCTACAGCGAGAAAGTGATCCAGG | |
| | AAAAGATGGAACAGGACATGAGCTGGCTGCAGGAAAAGGCCTTCCACCA | |
| | CCACGAGACAGTGGCCGCCCTGTATGAGGAATTCACCATCATCCCCCTGA | |
| | AGTTCTGCACCATCTATAAGGGAGAGGAATCCCTGCAGGCCGCCATCGAG | |
| | ATCAACAAAGAGAAGATCGAAAACTCCCTGACCCTGCTGCAGGGCAACG | |
| | AGGAATGGAACGTGAAGATCTACTGCGACGACACCGAGCTGAAGAAGGG | |
| | CATCAGCGAGACAAACGAGAGCGTGAAGGCCAAGAAGCAGGAAATCAGC | |
| | CACCTGAGCCCCGGCAGACAGTTCTTCGAGAAGAAGAAGATTGACCAGCT | |
| | CATCGAGAAAGAGCTGGAACTGCACAAGAACAAAGTGTGCGAGGAAATC | |
| | CACGACAAGCTGATTGAGCTGAGCCTCTACGACTCCGTGAAGAAGAACTG | |
| | GTCCAAGGACGTGACAGGCGCTGCCGAACAGATGGCCTGGAACAGCGTG | |
| | TTCCTGCTGCCCAGCCTGCAGATCACCAAGTTCGTGAACGAGATCGAGGA | |
| | ACTCCAGCAGCGGCTGGAGAACAAGGGATGGAAGTTCGAAGTGACCGGC | |
| | CCCTGGCCTCCCTACCACTTCAGCAGCTTTGCCGGGGCACCTGGCTCGGG | |
| | AGCGACCAACTTCTCATTACTCAAACAAGCCGGAGACGTTGAGGAGAATC | |
| | CAGGCCCTGTGCAGCCCGTGTCCCAGGCCAACGGCAGAATCCACCTGGAT | |
| | CCCGATCAGGCCGAACAGGGACTGGCCCAGCTCGTGATGACCGTGATCGA | |
| | GCTGCTGCGGCAGATCGTGGAACGGCACGCCATGAGAAGAGTGGAAGGC | |
| | GGCACCCTGACCGACGAGCAGATCGAGAATCTGGGAATCGCCCTGATGA | |
| | ACCTGGAAGAGAAGATGGACGAGCTGAAAGAGGTGTTCGGACTGGACGC | |
| | CGAGGACCTGAACATCGACCTGGGCCCTCTGGGCAGCCTGCTGTGATCGA | |
| | GTCTAGAGGGCCCCGTGGCTGTAATCTAGAGGATCCCTCGAGGGGCCCAA | |
| | GCTTACGCGTGCATGCGACGTCATAGCTCTCTCCCTATAGTGAGTCGTATT | |
| | ATAAGCTAGCTTGGGATCTTTGTGAAGGAACCTTACTTCTGTGGTGTGAC | |
| | ATAATTGGACAAACTACCTACAGAGATTTAAAGCTCTAAGGTAAATATAA | |
| | AATTTTTAAGTGTATAATGTGTTAAACTAGCTGCATATGCTTGCTGCTTGA | |
| | GAGTTTTGCTTACTGAGTATGATTTATGAAAATATTATACACAGGAGCTA | |
| | GTGATTCTAATTGTTTGTGTATTTTAGATTCACAGTCCCAAGGCTCATTTC | |
| | AGGCCCCTCAGTCCTCACAGTCTGTTCATGATCATAATCAGCCATACCAC | |
| | ATTTGTAGAGGTTTTACTTGCTTTAAAAAACCTCCCACACCTCCCCCTGAA | |
| | CCTGAAACATAAAATGAATGCAATTGTTGTTGTTAACTTGTTTATTGCAGC | |
| | TTATAATGGTTACAAATAAAGCAATAGCATCACAAATTTCACAAATAAAG | |
| | CATTTTTTTCACTGCATTCTAGTTGTGGTTTGTCCAAACTCATCAATGTATC | |
| | TTATCATGTCTGGATC | |

Example 24—Hybrid GVES Constructs can Produce Gas Vesicles in Mammalian Cells

Gvps from Different Organisms have been Combined Together to Produce Hybrid Gas vesicles reporting constructs.

Figure 25A:
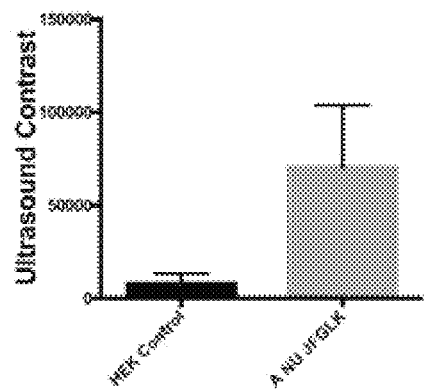
FIG. 25A shows HEK293T cells transfected with Ana-gpvA and the constructs in table 13 and table 14. After 72 hours of expression representative BURST ultrasound signal is quantified. HEK293T control without GV genes do not produce BURST ultrasound signal.

The applicants have combined Ana-gvpA, Table 10, with polynucleotide plasmids from *B. megaterium* of Table 13 and Table 14 to make a hybrid GV. The GVAs are from *Anabaena flos-aquae* and the GVS are from *B. megaterium*. HEK293T cells expressing constructs Ana-gvpA from Table 10, and constructs from Table 13 and Table 14 were able to produce gas vesicles as detectable by BURST ultrasound imaging (FIG. 25A). The skilled person will recognize that a hybrid construct with the above gene cassettes in addition to Ana-gvpC will also produce gas vesicles in mammalian cells as detectable by the methods described in this application.

Figure 25B:
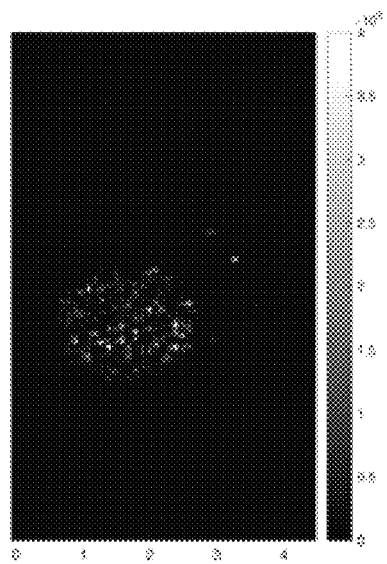
FIG. 25B shows Ana-gvpA, Ana-gvpC, Ana-gvpN from Table 10 together with *B. megaterium* GVS genes from Table 8. HEK293T cells expressing these hybrid genes were able to produce gas vesicles as detectable by BURST ultrasound imaging.

Similarly, the applicants have combined Ana-gvpA, Ana-gvpC, Ana-gvpN from Table 10, together with *B. megaterium* GVS genes from Table 8. HEK293T cells expressing these hybrid genes were able to produce gas vesicles as detectable by BURST ultrasound imaging (FIG. 25B).

Example 25: GVES Constructs Using *Anabaena flos-Aquae* Genes can Produce Gas Vesicles in Mammalian Cells Using gvps from Table 10, the applicants have expressed gas vesicles as detectable by TEM and ultrasound imaging in mammalian cells (e.g. HEK293T). HEK293T cells were transfected with the following constructs and were detectable by both TEM imaging (FIGS. 26A-D).

Figure 26A:
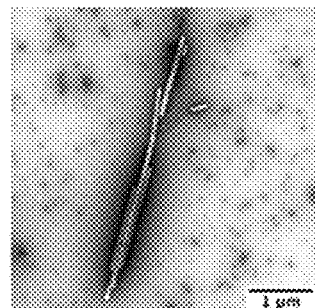
FIG. 26A shows HEK293T cells that have been transfected with Ana-gvpA, Ana-gvpC, Ana-gvpN, Ana-gpvJ, Ana-gvpK, Ana-gvpF, Ana-gvpG, Ana-gvpV, Ana-gvpW, and after 72 hours imaged with BURST ultrasound imaging.

The applicants have transfected HEK293T cells using gvps originating from *Anabaena flos-aquae* as catalogues in the NCBI database, with all genes have the same sequences as shown in Table 10 except for gvpG, which has the following sequence (MGSLTKLLLLPIMGPLNGVVWI-AEQIQERTNTEFDAQENLHKQLLSLQLSFDIGEIGEEE FEIQEEEILLKIQALEEEARLELEAEQEEARLELE-AEQEDFEYHLNSQQKLIKINISSCYLSI DGRK, SEQ ID NO: 456). Gas vesicles from this construct produces gas vesicles as detectable by BURST ultrasound imaging (FIG. 26E) but not TEM, since BURT ultrasound imaging is a more sensitive technique at detecting gas vesicle expression compared with TEM. The applicants sequenced gvpG gene from native *Anabaena flos-aquae* cells that natively express gas vesicles and found the gvpG sequence in table 10. HEK293T cells transfected with constructs from Table 10 produce gas vesicles as detectable by a higher BURST ultrasound signal (FIG. 26E) and TEM (FIG. 26A).

Figure 26B:
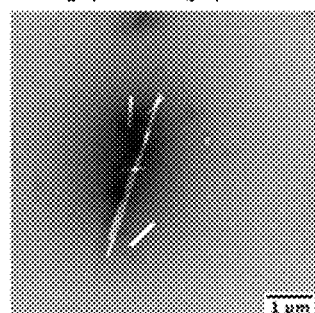
FIG. 26B shows HEK293T cells that have been transfected with Ana-gvpA, Ana-gvpN, Ana-gpvJ, Ana-gvpK, Ana-gvpF, Ana-gvpG, Ana-gvpV, Ana-gvpW, and after 72 hours cell lysate imaged with TEM.
Figure 26C:
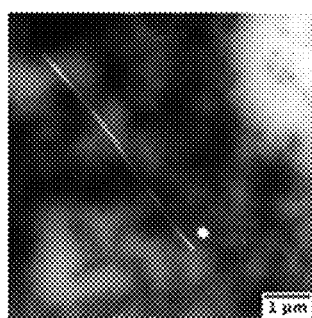
FIG. 26C shows HEK293T cells that have been transfected with Ana-gvpA, Ana-gvpN, Ana-gpvJ, Ana-gvpK, Ana-gvpF, Ana-gvpG, Ana-gvpW, and after 72 hours cell lysate imaged with TEM.
Figure 26D:
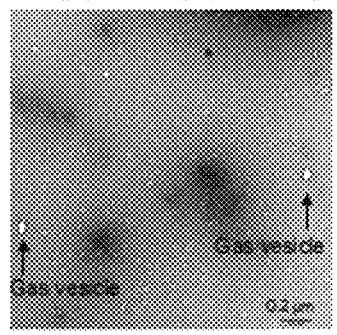
FIG. 26D shows HEK293T cells that have been transfected with Ana-gvpA, Ana-gpvJ, Ana-gvpK, Ana-gvpF, Ana-gvpG, Ana-gvpW, and after 72 hours cell lysate imaged with TEM. White arrows indicate small gas vesicle particles.
Figure 26E:
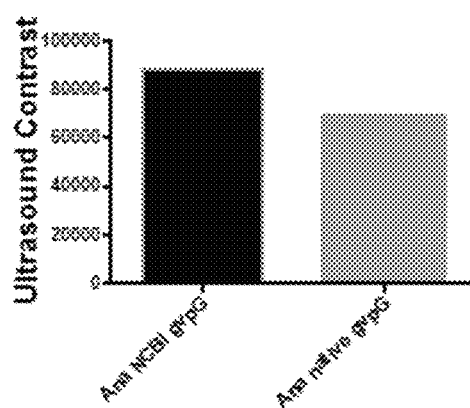
FIG. 26E shows HEK293T cells transfected with Ana GV genes with gene sequences acquired from the NCBI database (denoted ans Ana NCBI gvpG) and GV genes with gene sequences sequenced directly from native GV-expressing *Anabaena flos-aquae* cells. Representative BURST ultrasound images were quantified.

Gas vesicles with the structural properties of *Anabaena flos-aquae* genes can be tuned to have different non-linear properties using the structural protein gvpC [44] [45]. The applicants have demonstrated that HEK293T cells expressing the Ana genetic construct in FIG. 26A produces BURST ultrasound image (FIG. 27, panel A, left) but do not produce nonlinear ultrasound images using amplitude modulation (AM) ultrasound method (FIG. 27, panel B, left). However, HEK293T cells expressing Ana genetic construct in FIG. 26B are able to produce both BURST ultrasound image (FIG. 27, panel A, right) and nonlinear ultrasound images using AM ultrasound method (FIG. 27, panel B, right).

These different variants can be used for multiplexed imaging as their signature ultrasound properties can be distinguished. Importantly, GV constructs that can produce nonlinear ultrasound signal as detectable by amplitude modulation, pulse inversion, amplitude modulation pulse inversion, and other nonlinear ultrasound imaging methods known to the skilled person will be useful for detecting and imaging gas vesicles in complex biological environments (for example imaging inside the animal).

In summary, provided herein are genetically engineered gas vesicle expression systems (GVES) that are configured to express gas vesicles (GVs) in a mammalian cell, related gas vesicle polynucleotide constructs, gas vesicle reporting genetic circuits, vectors, genetically engineered mammalian cells, non-human mammalian hosts, compositions, methods and systems, which in several embodiments can be used together with contrast-enhanced imaging techniques to detect and report biological events in an imaging target site comprising a mammalian cell and/or organism.

The examples set forth above are provided to give those of ordinary skill in the art a complete disclosure and description of how to make and use the embodiments of the of the GVES system, polynucleotide constructs for expression of a gas vesicle in mammalian cells, and related GVR genetic circuits, vectors, genetically engineered mammalian cells, compositions, methods and systems of the disclosure, and are not intended to limit the scope of what the inventors regard as their disclosure. Those skilled in the art will recognize how to adapt the features of the exemplified polynucleotide GV constructs, and related genetic circuits, vectors, genetically engineered prokaryotic cells, compositions, methods and systems herein disclosed to additional polynucleotide GV constructs, and related genetic circuits, vectors, genetically engineered mammalian cells, compositions, methods and systems according to various embodiments and scope of the claims.

All patents and publications mentioned in the specification are indicative of the levels of skill of those skilled in the art to which the disclosure pertains.

The entire disclosure of each document cited (including patents, patent applications, journal articles, abstracts, laboratory manuals, books, or other disclosures) in the Background, Summary, Detailed Description, and Examples is hereby incorporated herein by reference. All references cited in this disclosure are incorporated by reference to the same extent as if each reference had been incorporated by reference in its entirety individually. However, if any inconsistency arises between a cited reference and the present disclosure, the present disclosure takes precedence. Further, the computer readable form of the sequence listing of the ASCII text file P2420-US-2020-05-05-Sequence-Listing-ST25 is incorporated herein by reference in its entirety.

The terms and expressions which have been employed herein are used as terms of description and not of limitation, and there is no intention in the use of such terms and expressions of excluding any equivalents of the features shown and described or portions thereof, but it is recognized that various modifications are possible within the scope of the disclosure claimed. Thus, it should be understood that although the disclosure has been specifically disclosed by embodiments, exemplary embodiments and optional features, modification and variation of the concepts herein disclosed can be resorted to by those skilled in the art, and that such modifications and variations are considered to be within the scope of this disclosure as defined by the appended claims.

It is also to be understood that the terminology used herein is for the purpose of describing particular embodiments only, and is not intended to be limiting. As used in this specification and the appended claims, the singular forms "a," "an," and "the" include plural referents unless the content clearly dictates otherwise. The term "plurality" includes two or more referents unless the content clearly dictates otherwise. Unless defined otherwise, all technical and scientific terms used herein have the same meaning as commonly understood by one of ordinary skill in the art to which the disclosure pertains.

When a Markush group or other grouping is used herein, all individual members of the group and all combinations and possible sub-combinations of the group are intended to be individually included in the disclosure. Every combination of components or materials described or exemplified herein can be used to practice the disclosure, unless otherwise stated. One of ordinary skill in the art will appreciate that methods, system elements, and materials other than those specifically exemplified may be employed in the practice of the disclosure without resort to undue experimentation. All art-known functional equivalents, of any such methods, device elements, and materials are intended to be included in this disclosure. Whenever a range is given in the specification, for example, a temperature range, a frequency range, a time range, or a composition range, all intermediate ranges and all subranges, as well as, all individual values included in the ranges given are intended to be included in the disclosure. Any one or more individual members of a range or group disclosed herein may be excluded from a claim of this disclosure. The disclosure illustratively described herein suitably may be practiced in the absence of any element or elements, limitation or limitations which is not specifically disclosed herein.

A number of embodiments of the disclosure have been described. The specific embodiments provided herein are examples of useful embodiments of the disclosure and it will be apparent to one skilled in the art that the disclosure can be carried out using a large number of variations of the genetic circuits, genetic molecular components, and methods steps set forth in the present description. As will be obvious to one of skill in the art, methods and systems useful for the present methods and systems may include a large number of optional composition and processing elements and steps.

In particular, it will be understood that various modifications may be made without departing from the spirit and scope of the present disclosure. Accordingly, other embodiments are within the scope of the following claims.

REFERENCES

1. Tashiro, Y., et al., *Molecular genetic and physical analysis of gas vesicles in buoyant enterobacteria*. Environmental microbiology, 2016. 18(4): p. 1264-1276.
2. Van Keulen, G., et al., *Gas vesicles in actinomycetes: old buoys in novel habitats?* Trends in microbiology, 2005. 13(8): p. 350-354.
3. Walsby, A. E., *Gas vesicles*. Microbiol. Rev., 1994. 58(1): p. 94-144.
4. Walsby, A. E., *Gas-vacuolate bacteria (apart from cyanobacteria)*, in *The Prokaryotes*. 1981, Springer. p. 441-447.
5. Walsby, A. E., *Cyanobacteria: planktonic gas-vacuolate forms*. The Prokaryotes, a Handbook on Habitats, Isolation, and Identification of Bacteria, 2013. 1: p. 224-235.
6. Woese, C. R., *Bacterial evolution*. Microbiological reviews, 1987. 51(2): p. 221.
7. Walsby, A. E., *Gas vesicles*. Microbiol Rev, 1994. 58(1): p. 94-144.
8. Pfeifer, F., *Distribution, formation and regulation of gas vesicles*. Nat. Rev. Microbiol., 2012. 10(10): p. 705-15.
9. Yi, G., S.-H. Sze, and M. R. Thon, *Identifying clusters of functionally related genes in genomes*. Bioinformatics, 2007. 23(9): p. 1053-1060.
10. Bourdeau, R. W., et al., *Acoustic reporter genes for noninvasive imaging of microorganisms in mammalian hosts*. Nature, 2018. 553(7686): p. 86-90.
11. Lakshmanan, A., et al., *Preparation of biogenic gas vesicle nanostructures for use as contrast agents for ultrasound and MRI*. Nat Protoc, 2017. 12(10): p. 2050-2080.
12. Hayes, P. and R. Powell, *The gvpA/C cluster of Anabaena flos-aquae has multiple copies of a gene encoding GvpA*. Archives of microbiology, 1995. 164(1): p. 50-57.
13. Kinsman, R. and P. Hayes, *Genes encoding proteins homologous to halobacterial Gvps N, J, K, F & L are located downstream of gvpC in the cyanobacterium Anabaena flos-aquae*. DNA Sequence, 1997. 7(2): p. 97-106.
14. Myers, E. W. and W. Miller, *Optimal alignments in linear space*. Computer applications in the biosciences: CABIOS, 1988. 4(1): p. 11-17.
15. Smith, T. F. and M. S. Waterman, *Comparison of biosequences*. Advances in applied mathematics, 1981. 2(4): p. 482-489.
16. Needleman, S. B. and C. D. Wunsch, *A general method applicable to the search for similarities in the amino acid sequence of two proteins*. Journal of molecular biology, 1970. 48(3): p. 443-453.
17. Pearson, W. R. and D. J. Lipman, *Improved tools for biological sequence comparison*. Proceedings of the National Academy of Sciences, 1988. 85(8): p. 2444-2448.
18. Karlin, S. and S. F. Altschul, *Methods for assessing the statistical significance of molecular sequence features by using general scoring schemes*. Proceedings of the National Academy of Sciences, 1990. 87(6): p. 2264-2268.
19. Karlin, S. and S. F. Altschul, *Applications and statistics for multiple high-scoring segments in molecular sequences*. Proceedings of the National Academy of Sciences, 1993. 90(12): p. 5873-5877.
20. Lu, G. J., et al., *Acoustically modulated magnetic resonance imaging of gas-filled protein nanostructures*. Nat Mater, 2018. 17(5): p. 456-463.
21. Pfeifer, F., *Distribution, formation and regulation of gas vesicles*. Nat Rev Microbiol, 2012. 10(10): p. 705-15.
22. Li, N. and M. C. Cannon, *Gas vesicle genes identified in Bacillus megaterium and functional expression in Escherichia coli*. J Bacteriol, 1998. 180(9): p. 2450-8.
23. Tashiro, Y., et al., *Molecular genetic and physical analysis of gas vesicles in buoyant enterobacteria*. Environ Microbiol, 2016. 18(4): p. 1264-76.
24. Ramsay, J. P., et al., *A quorum-sensing molecule acts as a morphogen controlling gas vesicle organelle biogenesis and adaptive flotation in an enterobacterium*. Proc Natl Acad Sci USA, 2011. 108(36): p. 14932-7.
25. Schechter, I. and A. Berger, *On the size of the active site in proteases. I. Papain*. Biochem Biophys Res Commun., 1967. 27(2): p. 157-162.
26. Schechter, I. and A. Berger, *On the active site of proteases. 3. Mapping the active site of papain; specific peptide inhibitors of papain*. Biochem Biophys Res Commun., 1968 32(5): p. 898-902.
27. Calvo, S. E., D. J. Pagliarini, and V. K. Mootha, *Upstream open reading frames cause widespread reduction of protein expression and are polymorphic among humans*. Proc Natl Acad Sci USA, 2009. 106(18): p. 7507-12.
28. Rose, A. B., *Intron-mediated regulation of gene expression*. Curr Top Microbiol Immunol, 2008. 326: p. 277-90.
29. Reddy A. S. N., G. M., *Nuclear pre-mRNA Processing in Plants. Current Topics in Microbiology and Immunology*. 326: p. 14.
30. Purnick, P. E. and R. Weiss, *The second wave of synthetic biology: from modules to systems*. Nat Rev Mol Cell Biol, 2009. 10(6): p. 410-22.
31. Buchler, N. E., U. Gerland, and T. Hwa, *On schemes of combinatorial transcription logic*. Proceedings of the National Academy of Sciences, 2003. 100(9): p. 5136-5141.
32. Silva-Rocha, R. and V. de Lorenzo, *Mining logic gates in prokaryotic transcriptional regulation networks*. FEBS letters, 2008. 582(8): p. 1237-1244.
33. Terreno, E., et al., *Challenges for Molecular Magnetic Resonance Imaging*. Chemical Reviews, 2010. 110(5): p. 3019-3042.
34. Cunningham, C. H., et al., *Positive contrast magnetic resonance imaging of cells labeled with magnetic nanoparticles*. Magnetic Resonance in Medicine, 2005. 53(5): p. 999-1005.
35. Foucault, M.-L., et al., *In vivo bioluminescence imaging for the study of intestinal colonization by Escherichia coli in mice*. Applied and environmental microbiology, 2010. 76(1): p. 264-274.
36. Daniel, C., et al., *Bioluminescence imaging study of spatial and temporal persistence of Lactobacillus plantarum and Lactococcus lactis in living mice*. Applied and environmental microbiology, 2013. 79(4): p. 1086-1094.
37. Chu, J., et al., *A bright cyan-excitable orange fluorescent protein facilitates dual-emission microscopy and enhances bioluminescence imaging in vivo*. Nat Biotech, 2016. 34(7): p. 760-767.
38. Smith-Bindman, R., et al., *Use of diagnostic imaging studies and associated radiation exposure for patients*

39. Foster, F. S., et al., *Advances in ultrasound biomicroscopy*. Ultrasound in medicine & biology, 2000. 26(1): p. 1-27.

40. Foster, F. S., et al., *Principles and applications of ultrasound backscatter microscopy*. Ultrasonics, Ferroelectrics and Frequency Control, IEEE Transactions on, 1993. 40(5): p. 608-617.

41. Errico, C., et al., *Ultrafast ultrasound localization microscopy for deep super-resolution vascular imaging.* Nature, 2015. 527(7579): p. 499-502.

42. Szymczak, A. L. and D. A. A. Vignali, *Development of 2A peptide-based strategies in the design of multicistronic vectors.* Expert Opinion on Biological Therapy, 2005. 5(5): p. 627-638.

43. Farhadi, A., et al., *Recombinantly Expressed Gas Vesicles as Nanoscale Contrast Agents for Ultrasound and Hyperpolarized MRI.* AIChE J, 2018. 64(8): p. 2927-2933.

44. Lakshmanan, A., et al., *Molecular Engineering of Acoustic Protein Nanostructures.* ACS Nano, 2016. 10(8): p. 7314-22.

45. Maresca, D., et al., *Nonlinear ultrasound imaging of nanoscale acoustic biomolecules.* Appl Phys Lett, 2017. 110(7): p. 073704.

enrolled in large integrated health care systems, 1996-2010. JAMA, 2012. 307(22): p. 2400-9.

SEQUENCE LISTING (480 sequences)

SEQ ID NO: 1 - protein, 125 aa, Artificial Sequence
  synthetic polypeptide
  MISC_FEATURE (1)..(125): X1 any amino acid or a sequence of any length having at least 50%, and more preferably 60% or higher, most preferably from 50% to 83% identity
  MISC_FEATURE (1)..(125): X2 any amino acid or a sequence of any length having at least 50%, and more preferably 60% or higher, most preferably from 50% to 83% identity
  MISC_FEATURE (1)..(125): X3 any amino acid or a sequence of any length having at least 50%, and more preferably 60% or higher, most preferably from 50% to 83% identity
  MISC_FEATURE (1)..(125): X4 any amino acid or a sequence of any length having at least 50%, and more preferably 60% or higher, most preferably from 50% to 83% identity
  MISC_FEATURE (1)..(125): X5 any amino acid or a sequence of any length having at least 50%, and more preferably 60% or higher, most preferably from 50% to 83% identity
  MISC_FEATURE (1)..(125): X6 any amino acid or a sequence of any length having at least 50%, and more preferably 60% or higher, most preferably from 50% to 83% identity
  MISC_FEATURE (1)..(125): X7 any amino acid or a sequence of any length having at least 50%, and more preferably 60% or higher, most preferably from 50% to 83% identity
  MISC_FEATURE (1)..(125): X8 any amino acid or a sequence of any length having at least 50%, and more preferably 60% or higher, most preferably from 50% to 83% identity
  MISC_FEATURE (1)..(125): X9 any amino acid or a sequence of any length having at least 50%, and more preferably 60% or higher, most preferably from 50% to 83% identity
  MISC_FEATURE (1)..(125): X10 any amino acid or a sequence of any length having at least 50%, and more preferably 60% or higher, most preferably from 50% to 83% identity
  MISC_FEATURE (1)..(125): X11 any amino acid or a sequence of any length having at least 50%, and more preferably 60% or higher, most preferably from 50% to 83% identity
  MISC_FEATURE (1)..(125): X12 any amino acid or a sequence of any length having at least 50%, and more preferably 60% or higher, most preferably from 50% to 83% identity
  MISC_FEATURE (1)..(125): X13 any amino acid or a sequence of any length having at least 50%, and more preferably 60% or higher, most preferably from 50% to 83% identity
RALXYLQAGYXVHXRGPAGTGKTTLAMHLAXXLXRPVMLIXGDDEFXTSDLIGSESGYXXKKVVDNYIHSVVKVEDELRQNWVDNRLTXACREGFTLVYDEFNRSRPEXNNVLLSVLEEKILXLP

SEQ ID NO: 2 - protein, 5 aa, Artificial Sequence
  synthetic polypeptide
GSGSG

SEQ ID NO: 3 - protein, 48 aa, Artificial Sequence
  synthetic polypeptide
  MISC_FEATURE (1)..(48): X can be any amino acid
SSSLAEVLDRILDKGXVIDAWARVSLVGIEILTIEARVVIASVDTYLR

SEQ ID NO: 4 - protein, 6 aa, Artificial Sequence
  synthetic polypeptide
LDRILD

SEQ ID NO: 5 - protein, 16 aa, Artificial Sequence
  synthetic polypeptide
  MISC_FEATURE (1)..(16): X can be any amino acid
RILDKGXVIDAWARVS

SEQ ID NO: 6 - protein, 5 aa, Artificial Sequence
  synthetic polypeptide
DTYLR

SEQ ID NO: 7 - protein, 6 aa, Artificial Sequence
  synthetic polypeptide
VVNMSV

SEQ ID NO: 8 - protein, 19 aa, Artificial Sequence
  synthetic polypeptide
KSPDSSSLAEVLDRILDKG

SEQ ID NO: 9 - protein, 36 aa, Artificial Sequence
  synthetic polypeptide
VIDAWARVSLVGIEILTIEARVVIASVDTYLRYAEA

SEQ ID NO: 10 - protein, 6 aa, Artificial Sequence
  synthetic polypeptide
NRLDLE

SEQ ID NO: 11 - protein, 308 aa, Artificial Sequence
  synthetic polypeptide
MTVLTDKRKKGSGAFIQDDETKEVLSRALSYLKSGYSIHFTGPAGGGKTSLARALAKKRKRPVMLMHGNHELNNKDLIGDFTGYTSKKVIDQYVRSVYKKDEQVSENWQDGRLLEAVKNGYTLIYDEFTRSKPATNNIFLSILEEGVLPLYGVKMTDPFVRVHPDFRVIFTSNPAEYAGVYDTQDALLDRLITMFIDYKDIDRETAILTEKTDVEEDEARTIVTLVANVRNRSGDENSSGLSLRASLMIATLATQQDIPIDGSDEDFQTLCIDILHHPLTKCLDEENAKSKAEKIILEECKNIDTEEK

SEQ ID NO: 12 - protein, 255 aa, Artificial Sequence
  synthetic polypeptide
MSETNETGIYIFSAIQTDKDEEFGAVEVEGTKAETFLIRYKDAAMVAAEVPMKIYHPNRQNLLMHQNAVAAIMDKNDTVIPISFGNVFKSKEDVKVLLENLYPQFEKLFPAIKGKIEVGLKVIGKKEWLEKKVNENPELEKVSASVKGKSEAAGYYERIQLGGMAQKMFTSLQKEVKTDVFSPLEEAAEAAKANEPTGETMLLNASFLINREDEAKFDEKVNEAHENWKDKADFHYSGPWPAYNFVNIRLKVEEK

SEQ ID NO: 13 - DNA, 4 bp, Artificial Sequence
  synthetic polynucleotide
tata

SEQ ID NO: 14 - RNA, 6 nt, Artificial Sequence
  synthetic polynucleotide
aauaaa

SEQ ID NO: 15 - protein, 19 aa, Artificial Sequence
  synthetic polypeptide
ATNFSLLKQAGDVEENPGP

SEQ ID NO: 16 - protein, 18 aa, Artificial Sequence
  synthetic polypeptide
EGRGSLLTCGDVEENPGP

SEQ ID NO: 17 - protein, 20 aa, Artificial Sequence
  synthetic polypeptide
QCTNYALLKLAGDVESNPGP

SEQ ID NO: 18 - protein, 22 aa, Artificial Sequence
  synthetic polypeptide
VKQTLNFDLLKLAGDVESNPGP

SEQ ID NO: 19 - protein, 22 aa, Artificial Sequence
  synthetic polypeptide
DVFRSNYDLLKLCGDIESNPGP

SEQ ID NO: 20 - protein, 22 aa, Artificial Sequence
  synthetic polypeptide
TLTRAKIEDELIRAGIESNPGP

SEQ ID NO: 21 - protein, 6 aa, Artificial Sequence
  synthetic polypeptide
GAPGSG

SEQ ID NO: 22 - protein, 8 aa, Artificial Sequence
  synthetic polypeptide
LEVLFQGP

SEQ ID NO: 23 - protein, 5 aa, Artificial Sequence
  synthetic polypeptide
DDDDK

SEQ ID NO: 24 - protein, 4 aa, Artificial Sequence
  synthetic polypeptide
IEGR

SEQ ID NO: 25 - protein, 7 aa, Artificial Sequence
  synthetic polypeptide
ENLYFQG

SEQ ID NO: 26 - protein, 6 aa, Artificial Sequence
  synthetic polypeptide
LVPRGS

SEQ ID NO: 27 - protein, 10 aa, Artificial Sequence
  synthetic polypeptide
DLEVVTSTWV

SEQ ID NO: 28 - protein, 10 aa, Artificial Sequence
  synthetic polypeptide
DEMEECASHL

SEQ ID NO: 29 - protein, 10 aa, Artificial Sequence
  synthetic polypeptide
DCSTPCSGSW

SEQ ID NO: 30 - protein, 10 aa, Artificial Sequence
  synthetic polypeptide
EDVVCCSMSY

SEQ ID NO: 31 - protein, 9 aa, Artificial Sequence
  synthetic polypeptide
DEMEECSQH

SEQ ID NO: 32 - DNA, 72 bp, Artificial Sequence
  synthetic polynucleotide
ggagcgccaggttccggggctactaacttcagcctccttaaacaggccggcgacgtggaagagaatcctggc

SEQ ID NO: 33 - protein, 72 aa, Artificial Sequence
  synthetic polypeptide
  misc_feature (46)..(46): Xaa can be any naturally occurring amino acid
  misc_feature (65)..(65): Xaa can be any naturally occurring amino acid
  misc_feature (72)..(72): Xaa can be any naturally occurring amino acid
MAVEKTNSSSSLAEVIDRILDKGIVIDAWVRVSLVGIELLAIEARXVIASVETYLKYAEAVGLTXSAAVPAX

SEQ ID NO: 34 - protein, 71 aa, Aphanizomenon flos-aquae
MAVEKTNSSSSLAEVIDRILDKGIVIDAWVRVSLVGIELLAIEARIVIASVETYLKYAEAVGLTQSAAVPA

SEQ ID NO: 35 - protein, 72 aa, Aphanothece halophytica
MAVEKTNSSSSLGEVVDRILDKGVVVDLWVRVSLVGIELLAVEARVVVASVETYLKYAEAVGLTSSAAVPAE

SEQ ID NO: 36 - protein, 71 aa, Anabaena flos-aquae; identical to SEQ ID NO: 34

SEQ ID NO: 37 - protein, 70 aa, Ancylobacter aquaticus
MAVEKINASSSLAEVVDRILDKGVVVDAWVRVSLVGIELLAVEARVVVAGVDTYLKYAEAVGLTASAQAA

SEQ ID NO: 38 - protein, 70 aa, Aquabacter spiritensis
MAVEKINASSSLAEVVDRILDKGVVVDAWVRVSLVGIELLAVEARVVVAGVDTYLKYAEAVGLTAGAQAA

SEQ ID NO: 39 - protein, 72 aa, Arthrospira sp. PCC-8005
MAVEKVNSSSSLAEVIDRILDKGIVIDAWVRVSLVGIELLSVEARVVIASVETYLKYAEAVGLTAQAAVPSV

SEQ ID NO: 40 - protein, 71 aa, Calothrix sp. Strain PCC-7601
MAVEKTNSSSSLAEVIDRILDKGIVVDAWVRVSLVGIELLAIEARIVIASVETYLKYAEAVGLTQSAAVPA

SEQ ID NO: 41 - protein, 72 aa, Dactylococcopsis salina PCC-8305
MAVEKTNSSSSLGEVVDRILDKGVVVDLWVRVSLVGIELLAVEARVVIASVETYLKYAEAVGLTSSAAVPAE

SEQ ID NO: 42 - protein, 71 aa, Dolichospermum circinale AWQC131C; identical to SEQ ID NO: 34

SEQ ID NO: 43 - protein, 71 aa, Dolichospermum lemmermannii; identical to SEQ ID NO: 34

SEQ ID NO: 44 - protein, 70 aa, Enhydrobacter aerosaccus
MAVEKMNASSSLAEVVDRILDKGIVIDAWVRVSLVGIELLAVEARVVVAGVDTYLKYAEAVGLTAGAEAA

SEQ ID NO: 45 - protein, 72 aa, Lyngbya confervoides BDU141951
MAVEKVNSSSSLAEVVDRILDKGIVVDAWVRVSLVGIELLAIEARVVIASVETYLKYAEAVGLTAQAAVPAS

SEQ ID NO: 46 - protein, 73 aa, Nostoc punctiforme PCC-73102
MAVEKVNSSSSLAEVIDRILDKGIVIDAWVRVSLVGIELLSIEARIVIASVETYLRYAEAVGLTSQAAVPSAA

SEQ ID NO: 47 - protein, 71 aa, Nostoc sp. PCC-7120
MAVEKTNSSSSLAEVIDRILDKGIVVDAWVRVSLVGIELLAIEARIVIASVETYLKYAEAVGLTQSAAMPA

SEQ ID NO: 48 - protein, 71 aa, Microchaete diplosiphon; identical to SEQ ID NO: 40

SEQ ID NO: 49 - protein, 71 aa, Microcystis aeruginosa NIES-843
MAVEKTNSSSSLAEVIDRILDKGIVIDAWARVSLVGIELLAIEARVVIASVETYLKYAEAVGLTQSAAVPA

SEQ ID NO: 50 - protein, 71 aa, Microcystis aeruginosa NIES-843; identical to SEQ ID NO: 49

SEQ ID NO: 51 - protein, 71 aa, Microcystis aeruginosa NIES-843; identical to SEQ ID NO: 49

SEQ ID NO: 52 - protein, 71 aa, Microcystis flos-aquae TF09; identical to SEQ ID NO: 49

SEQ ID NO: 53 - protein, 72 aa, Phormidium tenue NIES-30
MAVEKVNSSSSLAEVVDRILDKGIVIDAWVRVSLVGIELLAIEARVVIASVDTYLKYAEAVGLTAQAAVPAA

SEQ ID NO: 54 - protein, 72 aa, Planktothrix agardhii
MAVEKVNSSSSLAEVIDRILDKGIVIDAWVRVSLVGIELLSIEARIVIASVETYLKYAEAVGLTAQAAVPSV

SEQ ID NO: 55 - protein, 72 aa, Planktothrix rubescens; identical to SEQ ID NO: 54

SEQ ID NO: 56 - protein, 72 aa, Pseudanabaena galeata PCC-6901
MAVEKVNSSSSLAEVIDRILDKGIVIDAWVRVSLVGIELLSIEARVVIASVETYLKYAEAVGLTASAAVPAA

SEQ ID NO: 57 - protein, 70 aa, Stella vacuolata
MAVEKINASSSLAEVVDRILDKGVVVDAWVRVSLVGIELLAVEARVVVAGVDTYLKYAEAVGLTAGAQTA

SEQ ID NO: 58 - protein, 75 aa, Trichodesmium erythraeum IMS101
MAVEKVNSSSSLAEVIDRILDKGVVVDAWIRLSLVGIELLTIEARIVVASVETYLKYAEAVGLTTLAAAPGEAAA

SEQ ID NO: 59 - protein, 72 aa, Trichodesmium erythraeum IMS101
MAVEKVNSSSSLAEVIDRILDKGVVVDAWVRLSLVGIELLTIEARIVIASVETYLKYAEAVGLTTLAAEPAA

SEQ ID NO: 60 - protein, 71 aa, Tolypothrix sp. PCC-7601; identical to SEQ ID NO: 40

SEQ ID NO: 61 - protein, 71 aa, Tolypothrix sp. PCC-7601; identical to SEQ ID NO: 40

SEQ ID NO: 62 - protein, 78 aa, Artificial sequence
  synthetic polypeptide
  misc_feature (29)..(29): Xaa can be any naturally occurring amino acid
  misc_feature (73)..(73): Xaa can be any naturally occurring amino acid
MAQPDSSSLAEVLDRVLDKGVVVDVWARXSLVGIEILTVEARVVAASVDTFLHYAEEIAKIEQAELTAGAEAXPAPEA

SEQ ID NO: 63 - protein, 76 aa, Halobacterium salinarum
MAQPDSSGLAEVLDRVLDKGVVVDVWARVSLVGIEILTVEARVVAASVDTFLHYAEEIAKIEQAELTAGAEAAPEA

SEQ ID NO: 64 - protein, 79 aa, Halobacterium salinarum
MAQPDSSSLAEVLDRVLDKGVVVDVWARISLVGIEILTVEARVVAASVDTFLHYAEEIAKIEQAELTAGAEAPEPAPEA

SEQ ID NO: 65 - protein, 76 aa, Halobacterium salinarum NRC-1; identical to SEQ ID NO: 63

SEQ ID NO: 66 - protein, 79 aa, Halobacterium salinarum NRC-1; identical to SEQ ID NO: 64

SEQ ID NO: 67 - protein, 78 aa, Haloferax mediterranei ATCC-33500
MVQPDSSSLAEVLDRVLDKGVVVDVWARISLVGIEILTVEARVVAASVDTFLHYAEEIAKIEQAELTAGAEAAPTPEA

SEQ ID NO: 68 - protein, 78 aa, Halogeometricum borinquense DSM-11551
MAQPDSSSLAEVLDRVLDKGVVVDVWARVSLVGIEILTVEARVVAASVDTFLHYAEEIAKIEQAELTATAEAAPTPEA

SEQ ID NO: 69 - protein, 76 aa, Halopenitus persicus strain DC30; identical to SEQ ID NO: 63

SEQ ID NO: 70 - protein, 72 aa, Haloquadratum walsbyi C23
MAQPDSSSLAEVLDRVLDKGIVVDTFARISLVGIEILTVEARVVVASVDTFLHYAEEIAKIEQAELTAGAEA

SEQ ID NO: 71 - protein, 78 aa, Halorubrum vacuolatum strain DSM-8800
MAQPDSSSLAEVLDRVLDKGVVVDVYARLSLVGIEILTVEARVVAASVDTFLHYAEEIAKIEQAELTAGAEAAPTPEA

SEQ ID NO: 72 - protein, 95 aa, Halopiger xanaduensis
MAQPQRRPDSSSLAEVLDRILDKGVVIDVWARISVVGIELLTIEARVVVASVDTFLHYAEEIAKIEQATAEGDLEELEELEVEPRPESSPQSAAE

SEQ ID NO: 73 - protein, 95 aa, Natrialba magadii ATCC-43099
MAQPQRRPDSSSLAEVLDRVLDKGVVIDIWARVSVVGIELLTVEARVVVASVDTFLHYAEEIAKIEQATAEGDLEDLEELEVEPRPESSPKSATE

SEQ ID NO: 74 - protein, 94 aa, Natrinema pellirubrum DSM-15624
MAQPQRRPDSSSLAEVLDRVLDKGVVIDVWARISVVGIELLTIEARVVVASVDTFLHYAEEIAKIEQATAEGDLDELEELEVEPRPESSPKSAE

SEQ ID NO: 75 - protein, 95 aa, Natronobacterium gregoryi SP2
MAQPQRRPDSSSLAEVLDRILDKGVVIDVWARVSVVGIELLTIEARVVVASVDTFLHYAEEIAKIEQATAEGDLEDLEELEVEPRPESSPQSATE

SEQ ID NO: 76 - protein, 74 aa, Methanosaeta thermophila
MVTSTPDSSSLAEVLDRILDKGIVVDVWARVSLVGIEILTVEARVVVASVDTFLHYSEEMAKIEQAAIAAAPSA

SEQ ID NO: 77 - protein, 76 aa, Methanosaeta thermophila
MVTSTPDSSSLAEVLDRILDKGIVVDVWARVSLVGIEILTVEARVVVASVDTFLHYSEEMAKIEQAAIAAAPGVPA

SEQ ID NO: 78 - protein, 76 aa, Methanosarcina barkeri-3
MVSQSPDSSSLAEVLDRILDKGIVVDVWARVSLVGIEILAIEARVVVASVDTFLHYAEEITKIEIAAKEEKPAIAA

SEQ ID NO: 79 - protein, 76 aa, Methanosarcina vacuolata
MVSQSPDSSSLAEVLDRILDKGIVVDTWARVSLVGIEILAIEARVVVASVDTFLHYAEEITKIEIAAREEKPVIAA

SEQ ID NO: 80 - protein, 76 aa, Methanosarcina vacuolata
MVSQSPDCSSLAEVLDRILDKGIVVDTWARVSLVGIEILAIEARVVVASVDTFLHYAEEITKIEIAAREEKPVIAA

SEQ ID NO: 81 - protein, 87 aa, Haladaptatus paucihalophilus DX253
MVQAEPNSSSLADVLDRILDKGVVIDVWARISVVGIEVLTVEARVVVASVDTFLHYAKEMAKLERASSEDEIDFEQVEVASPEASTS

SEQ ID NO: 82 - protein, 73 aa, Artificial sequence
  synthetic polypeptide
  misc_feature (8)..(8): Xaa can be any naturally occurring amino acid
  misc_feature (34)..(34): Xaa can be any naturally occurring amino acid
  misc_feature (73)..(73): Xaa can be any naturally occurring amino acid
MSIQKSTXSSSLAEVIDRILDKGIVIDAFARVSXVGIEILTIEARVVIASVDTWLRYAEAVGLLDVEEGLPRX

SEQ ID NO: 83 - protein, 86 aa, Bacillus megaterium
MSIQKSTDSSSLAEVIDRILDKGIVIDAFARVSLVGIEILTIEARVVIASVDTWLRYAEAVGLLTDKVEEEGLPGRTEERGAGLSF

SEQ ID NO: 84 - protein, 88 aa, Bacillus megaterium
MSIQKSTNSSSLAEVIDRILDKGIVIDAFARVSVVGIEILTIEARVVIASVDTWLRYAEAVGLLRDDVEENGLPERSNSSEGQPRFSI

SEQ ID NO: 85 - protein, 72 aa, Artificial sequence
  synthetic polypeptide
  misc_feature (31)..(31): Xaa can be any naturally occurring amino acid
  misc_feature (67)..(67): Xaa can be any naturally occurring amino acid
MAKVQKSTDSSSLAEVVDRILDKGIVIDAWXKVSLVGIELLSIEARVVIASVETYLKYAEAIGLTAXAAAPA

SEQ ID NO: 86 - protein, 73 aa, Burkholderia sp. Bp5365
MAKVQKSTDSSSLAEVVDRILDKGIVIDVWAKVSLVGIELLSIEARVVIASVETYLKYAEAIGLTATAAAPTA

SEQ ID NO: 87 - protein, 72 aa, Desulfobacterium vacuolatum DSM-3385
MAKVQKTTDSSSLAEVVDRILDKGIVVDAWAKISLVGIELISIEARVVIASVETYLKYAEAIGLTAAAAAPA

SEQ ID NO: 88 - protein, 72 aa, Desulfomonile tiedjei DSM-6799
MAKIAKSTDSSSLAEVVDRILDKGIVIDAWAKVSLVGIELLSVEARVVIASVETYLKYAEAIGLTASAAAPA

SEQ ID NO: 89 - protein, 72 aa, Isosphaera pallida ATCC-43644
MAKVTKSTDSSSLAEVVDRILDKGIVIDAFAKVSLVGIELLSVEARVVIASVETYLKYAEAIGLTASAATPA

SEQ ID NO: 90 - protein, 72 aa, Lamprocystis purpurea DSM-4197
MAKVANSTDSSSLAEVVDRILDKGIVIDAWIKVSLVGIELLAIEARIVIASVETYLKYAEAIGLTAPAAAPA

SEQ ID NO: 91 - protein, 72 aa, Lamprocystis purpurea DSM-4197
MAKVANSTDSSSLAEVVDRILDKGIVIDAWLKVSLVGIELLAVEARVVIASVETYLKYAEAIGLTAPAAAPA

SEQ ID NO: 92 - protein, 72 aa, Legionella drancourtii LLAP12
MAKVQKSTDSSSLAEVIDRILDKGIVIDVWAKVSLVGIELLSIEARVVIASVETYLKYAEAIGLTATASHPA

SEQ ID NO: 93 - protein, 72 aa, Psychromonas Ingrahamii
MANVQKTTDSSGLAEVIDRILDKGIVIDAFVKVSLVGIELLSIEARVVIASVETYLKYAEAIGLTASAATPA

SEQ ID NO: 94 - protein, 72 aa, Psychromonas Ingrahamii
MANVQKSTDSSGLAEVVDRILEKGIVIDAFVKVSLVGIELLSIEARVVIASVETYLKYAEAIGLTASAATPA

SEQ ID NO: 95 - protein, 72 aa, Serratia 39006
MAKVQKSTDSSSLAEVVDRILDKGIVIDAWVKVSLVGIELLSIEARVVIASVETYLKYAEAIGLTASAATPA

SEQ ID NO: 96 - protein, 72 aa, Thiocapsa rosea strain DSM-235-Ga0242571-11
MAKVANSTDSSSLAEVVDRILDKGIVIDAWVKVSLVGIELLAIEARVVIASVETYLKYAEAIGLTAPAAAPA

SEQ ID NO: 97 - protein, 70 aa, Bradyrhizobium oligotrophicum S58
MAIEKATASSSLAEVIDRILDKGVVIDAFVRVSLVGIELLSIELRAVVASVETWLKYAEAIGLVAQPMPA

SEQ ID NO: 98 - protein, 71 aa, Desulfotomaculum acetoxidans DSM-771
MAVKHSVASSSLVEVIDRILEKGIVIDAWARVSLVGIELLAIEARVVVASVDTFLKYAEAIGLTKFAAVPA

SEQ ID NO: 99 - protein, 67 aa, Octadecabacter antarcticus 307
MAVNKMNSSSSLAEVVDRILDKGVVIDAWVRVSLVGIELIAVEARVVIAGVDTYLKYAEAVGLTAEA

SEQ ID NO: 100 - protein, 67 aa, Octadecabacter arcticus 238
MAVSKMNSSSSLAEVVDRILDKGVVIDAWVRVSLVGIELIAVEARVVIAGVDTYLKYAEAVGLTAEA

SEQ ID NO: 101 - protein, 68 aa, Pelodictyon luteolum DSM-273
MAVEKTIGSSSLVEVIDRILDKGVVVDAWVRMSLVGIELLAIEARVVVASVETYLKYAEAIGLTAKAA

SEQ ID NO: 102 - protein, 68 aa, Pelodictyon luteolum DSM-273
MAVEKTIGSSSLVEVIDRILDKGVVVDAWVRVSLVGIELLAIEARVVVASVETYLKYAEAIGLTAKAA

SEQ ID NO: 103 - protein, 68 aa, Pelodictyon phaeoclathratiforme
MSVEKTIGSSSLVEVIDRILDKGVVVDAWVRVSLVGIELLAIEARVVVASVETYLKYAEAIGLTAKAA

SEQ ID NO: 104 - protein, 70 aa, Rhodobacter capsulatus SB-1003
MAIEKSLASASIAEVIDRVLDKGIVVDAFVRISLVGIELLAIELRAVVASVETWLKYAEAIGLTVDPQTP

SEQ ID NO: 105 - protein, 70 aa, Rhodobacter sphaeroides
MAIEKSVASASIAEVIDRILDKGVVIDAFVRVSLVGIELIAIEVRAVVASIETWLKYAEAVGLTVDPATT

SEQ ID NO: 106 - protein, 245 aa, Anabaena flos-aquae
MSIPLYLYGIFPNTIPETLELEGLDKQPVHSQVVDEFCFLYSEARQEKYLASRRNLLTHEKVLEQTMHAGFRVLLPLRFGLVVKDWETIMSQLINPHKDQLNQLFQKLAGKREVSIKIFWDAKAELQTMMESHQDLKQQRDNMEGKKLSMEEVIQIGQLIEINLLARKQAVIEVFSQELNPFAQEIVVSDPMTEEMIYNAAFLIPWESESEFSERVEVIDQKFGDRLRIRYNNFTAPYTFAQLDS

SEQ ID NO: 107 - protein, 268 aa, Ancylobacter aquaticus strain UV5
MSATLSAPGTANVAVEATAAADGKYLYGIIEAPAPATFDVPAIGGRGDVVHTIALGRLAAVVSNSPRIDYDNSRRNMLAHTKVLEAVMARHTLLPVCFGTVGSDAEVIIEKILRERRDELAGLLGQMHGRMELGLKASWREEIIFEEVLAENPAIRKLRDALVGRSPDQSHYERIQLGERIGQALQRKRQDDEERILERVRPFVHKTRLNKLIGDRMVINAAFLVDAAVESRLDASIRAMDEEWGGRLAFKYVGPVPPYNFVTITIHW

SEQ ID NO: 108 - protein, 245 aa, Aphanizomenon flos-aquae NIES-81
MNTGLYLYGIFPDPIPETVDLQGLDKQSVHSQVVDGFSFLYSDACQEKYLASRRNLLTHEKVLEQAMHEGFHVLLPLRFGLVVKDWETIQKQLIEPYKEQLNELFQKLAGQREVSIKILWDSKSELQAMMESNQDLKQQRDNMEGKKLKMEEIIQIGQLIESNLAARKQTVIQEFFNNLHPLAKEIIESEPMTEEMIYNAAFLIPWETESVFSERVEAIDRKFGDRLRIRYNNFTAPYTFAQLAS

SEQ ID NO: 109 - protein, 245 aa, Aphanothece halophytica strain PCC 7418
MAEGFYLYGIFPPPGPQTIAVQGLDKQPIFSHTVEGFTFLYSEAQQSRYLASRRNLITHTKVLEEAMEQGFRTLLPLQFGLVVPDWESVSQDLLQHQSETLQLLFQRLEGKREVSLKIYWETDAELNALLEENPDLKARRDNLEGKNLSMDEVIQIGQALEQAMERRKQEVITRFEDALIPFAVETQENDVLTETMIYNTAFLIPWESEPEFGEAVETVDAEFAPRLKIRYNNFTPPYNFVELRE

SEQ ID NO: 110 - protein, 261 aa, Aquabacter spiritensis strain DSM 9035
MMQTDTLAPAETVAEGKYLYCLIDAPAPDTFASPGIGGRGDVVHTITVGRLAAVVSDSPRIEYENSRRNMMAHTKVLEEVMARHTMLPVCFGTVATGPDPISGKILEGRRDELVGLLEQMRGRLELGLKATWREDVIFAEILQENPAIAKLRDSLVGRSPEKSHFERIRLGEMIGQAMERKRRDDEERILERVRPFVHKTKLNKPIGDRMILNAAVLVEAAREAGLDQAVRQMDAEWGARLSFKYVGPVPPYNFVTITIHW

SEQ ID NO: 111 - protein, 255 aa, Bacillus-megaterium; identical to SEQ ID NO: 12

SEQ ID NO: 112 - protein, 258 aa, Bradyrhizobium oligotrophicum S58
MSNQPIYVYGLIRAEDHQPLAVRAVGDSEQPVNIIGSGNVAALVSTIDLPEIMPTRRHMLAHTKVLEAAMANGPVLPMRFGIIVPNPATLLRVIGFRHQELRARLDEIDGRIEVALKASWDEQFMWRQLASEHPDLAVSGRTMMGRGEQQSYYDRIELGRAIGAALEERRTAARLQLLQTVTPFAVQVKELTPVDDAMFAHLALLVEKGAEPSLYQTVEALERSNDSGLKFRYVAPIPPYNFVAVTLDWEQHEQAPRR

SEQ ID NO: 113 - protein, 249 aa, Burkholderia thailandensis sp. Bp5365 strain MSMB43
MNSRNGARYLYAVQHARDVPASLPAGIGGAAVRALTDGDVAAIVSDTGLAKVRPERRHLLAHHTVIQSLAAAGTVLPVAFGTIATSEVALRRMLRKHRNALAGELARLVDHVEMSVRLNWDVTDLFRHLIDVRPDLKAARDAMLALGSAVTRDDKIELGSRFERVLNEERARHAALVDEALDACCKEIRRDPPRHETEILHLTCLVRHAELGRFESGVAAASRELDDSLVLKYSGPCPPHHFVNLNMSL

SEQ ID NO: 114 - protein, 260 aa, Chlorobium luteolum DSM 273
MERDGKYIYCIIGADCECDFGPIGIGGRGDLVSTIGFEGISMVVSDHPLNRFVVDPDGILAHQRVIEAVMKEHESVIPVRFGTVAATPDEIRNLLDRRYGELSELLLRLRNKVEFNVTGRWHDMAAIYKEVERTHPEIKEQRARIESMRDGDGEALKQSLILDTGHQIEAALEVMKEEKFDAVASLFRKTAMASKMNRTTSPDMFMNAAFLIDRGREVEFDGIMEILGQKDADRCDYRYSGPLAIFNFVDLRILPEKWEL

SEQ ID NO: 115 - protein, 259 aa, Chlorobium luteolum DSM 273
MAHEAAEQDGLYIYGIINNSGELDFGPIGIGGREERVYAVIHNDIAAVVSRTVVKEFEPRRANMIAHQKVLEAVMVSHAVLPVRFSTVSPGHDDMKVEKILEEDYLRLKKLLVKMEGKKEMGLKVMANEEKVYESIITGYDNIRYLRDKLINLPPEKTHYQRVKIGELVAAALEKEVGTYKDAVLDALSPIAEEVKVNDSYGSMMVLNAAFLIRTAREEEFDRAVNALDDRYHDMMTFKYVGTLPPYNFVNISINIKGR

SEQ ID NO: 116 - protein, 343 aa, Chlorobium luteolum DSM 273
MNQSIYIYGIVNEPALAASFVETDPDIYAVASMGCSAIVENRPAIDLGELDRESLARMLLQHQQTLERLMESGMQLIPLKLGTFVSSAADAACIIEDGYNLIERIFRETEDAHELEVVVKWSSFADLLQEVVSEGDVQELKREVEARQSSSTEDAIAVGRLIKEKIDRRNAALSASVLRQLGERASQSKRHETMDDEMVLNAAFLVNRGDVDAFVATVEALDSQYLNALHFRIVGPLPCYSFYTLEVTALFEEFIAEKRAVLGLDARSCEADVKKAYHAKAKVAHPDVHVPAGANNGADFTVLNEAYMTLHDYYSALRNSASSRHGHEGQDSSSVVFSVKILN

SEQ ID NO: 117 - protein, 245 aa, Dactylococcopsis salina PCC 8305
MTEGFYLYGIFPPPGPKTIETQGLDKQPIFSHTVEGFTFLYSEAQQSRYLASRRNLITHTKVLEEAMENGSRTLLPLQFGLIVPDWETVVQDLLQHQAESLHFFLEKLEGKREVSLKIYWETNAELNALLEENPALKARRDNLEGKQLSMDEVIQIGQALEQEMEGRKQDIISRFEEVLIPFAFEIKENDVLTETMIYNTAFLINWDAESDFGEQLEAIDAEFSPRLKIRYNNFTPPYNFVELRE

SEQ ID NO: 118 - protein, 252 aa, Desulfobacterium vacuolatum DSM 3385
MSKKNLKRNGRYLYAIIEASEEKTFGSIGMDGSDVYLIVEDKTAAVVSDVPNKKIRPQRKNIAAHHAVLNKIMEEITPLPMAFGIIADGEQAIRKILADNRDVFREQFATVSGKVEMGMRISYDVPNIFEYFISTDSEIRAARDQYFGGNREPSQEAKLELGRMFNRQLNANREEYTNQVIEILDDYCDDIKENKCRNEQEVTSLACLINRSDQKRFEEGVFESARHFDNNFSFEYNGPWSPHNFVNILIEL

SEQ ID NO: 119 - protein, 255 aa, Desulfomonile tiedjei DSM 6799
MEKATIKTTGSNGRYLYAVVPGSQERVYGCLGINGGNVYTIAAKDVAAVVSDVPHQKIRPERRHFAAHQAVLKRVMLDGDLLPMSFGIISQGPKAVRAILSRNNKSVQQQLKRISGKAEMGIKVTWDVPNIFEYFIDVNRELREARNKLVQPNYLPTQQEKIEIGRMFEEILNLERERHTKQVERVMSKRCSEIKRSKCRTEIEVMNLSCLVDRTLLSDFEAGVLEAASHFDDSFAFDFNGPWAPHNFVDLEIDV

SEQ ID NO: 120 - protein, 250 aa, Desulfotomaculum acetoxidans DSM 771
MSTGRYVYCVINSIEPLTFMSGPVGNEPEGVFTVHYKELAAVVSQSSEEKYNVCRENTIAHQKVLEEVLVSHPLLPVRFGTVAQNEEIVKKFLLQERYAELRSMLHNVTGKVQMGLKVLWTDMKTVYQEIVEENPQIKNLKKKLESKPAETIHYEMIDLGQMVNQALLRKKEKQKEMVLKPLQKIALETKESFLYGDQMFVNADFLISRSSLDDFNAKVNELGEFFNEQALFKYIGPLPPYNFVTLYVNF

SEQ ID NO: 121 - protein, 357 aa, Desulfotomaculum acetoxidans DSM 771
MVKNHNTDHLKELYIYGLIGGTPFKDELEKISVIQENTPIYGVWHKNIGFAVSAAPDYPLKDLSKESIIQLFVDHQQVLECLRQKFSLIPVKLGTVLESVTEAAAVLANNEEKFNDLLNYLKDKVELNLSVSWNDLNEVVAKIGEEDEVKKLKQSLLAQEQVSQEDLIKIGKIISFQMQQKKQAAREYIISELRNLWEDYFINEVVDENSILNLTLLAITGKVDDVNKKIEYLNQIYRDSLDFSLTKSLLPQGFSTVSIKKITMDQLLLAKDILKLPDTASLQDINAARRALLHCYHPDKNDHAAVNKVQEINAAYKLLEEYCQENSSDFNVDLITDYYIMKVIKADKSNVNSMNME

SEQ ID NO: 122 - protein, 252 aa, Dolichospermum circinale
MNTDLAHKNFGLYLYGIFPDTIPETLEIKGLDGKSVHSQVVDGFTFLYSQACQEKYLASRRNLLAHERVLEQTMHEGFHVLLPLRFGLVVKDWETIMSQLINPHKEQLHKLFEKLAGQREVSIKILWDAKAELQAMMESNHDLRQQRDNMEGKKLSMEEVIQIGQLIESNLQARKQAVIEVFTRELNPLAQEIVVSEPMTEEMIYNAAFLIPWDSEPLFSERVESIDQKFGNRLRIRYNNFTAPYTFALLDS

SEQ ID NO: 123 - protein, 277 aa, Enhydrobacter aerosaccus strain ATCC 27094
MNPPEAYIAGRTAAKSVEDRKARPQDLAEGKYVYAIIACDEPREFKNRGIGERGDKVHTINHRQMAAVVSDSPTIDYERSRRNMMAHTVVLEEVMKEFDLLPLRFGTVASSAESVERQLLVPRYGELSAMLEKMRGRSEFGLKAFWHEGVAFGEIVRENARVRKLRDALQGRSLEESYYQRIQLGEEVEKALTAIRARDEELILSRLRPFMRDIRTNKIISDRMVLNAAFLVERGDVPALDEAIRQLDQEFSERLMFKYVGPVPPYNFVNIAINWER

SEQ ID NO: 124 - protein, 279 aa, Isosphaera pallida ATCC-43644
MRNAPPTRPGSVTPASPGKPVIDGPARYLYAFTHDLPEGPLADLEGLPGARVVVVADGRVAAVVSPCPLGKVRPERQRVAGHHHVLKHLQDTLGKAILPASFGMVADSEEDLRALLRHHSAAIAEGLVRVQGKVEMTVKLRWAPDNVAQAVLGRDPELRQLRDQLYSNGQTPTRDQSLDLGRRFHHALERQRDHYAAYLRAALSPLLSELVEEDLRDERDLVHWACLIENQRRAGFEAALDRLAEELEDDLVLELTGPWPPHHFVDLDLDDDHDDDEEE

SEQ ID NO: 125 - protein, 258 aa, Legionella drancourtii LLAP12
MDSTSKKPAASNLYLYAIASVNENQEPISFHGIEEQPIDLVPYKDIMLVVSNLSKKKVRPERKNVAVHHAVLNHLMKHNTSMLPIRFGMIADNRKEVQRLLTINYDMLHTKLKMMAGRVEMGVSLSWDVPNIFEYLLNRHSQLRETRDKLLANPAHEPSRDEKIEIGALFSQILDEEREVYTDTILSLLSPVCCDVVKSTYRNDTEIMNIFCLISAARRDEFEEKIIEASTILDDNFVIKYTGPWPPHNFSKLNLSLE

SEQ ID NO: 126 - protein, 247 aa, Lyngbya confervoides BDU141951
MPQLLYLYGIFPAPGPQDLEVQGLDQQPIHTHIIDEFVFLYSVAQQERYLASRKNLLGHERVLEAAMKVGYRTLLPLQFGLIIETWDRVIKELITPRGDALKRLFAKLEGRREVSVKLLWGPDAELNQLMEEDAGLRAERDRLEGQQLSMDQIVDIGQAIETAMTERKDDVINAFRQRLNALAIEVLENDPLTDAMIYNTAYLIPWEDEVKFSQAIEELDEQFEDRLRIRYNNFTAPYNFAQLDQLS

SEQ ID NO: 127 - protein, 244 aa, Microcystis aeruginosa NIES-843
MTVGLYLYGIFPEPVPDGLVLQGIDNEPVHSEMIEGFSFLYSAAHKEKYLASRRYLICHEKVLETVMEAGFTTLLPLRFGLVIKTWESVTEQLISPYKTQLKELFAKLSGQREVSIKIFWDNQWELQAALESNPKLKQERDAMMGKNLNMEEIIHIGQLIEATVLQRKQDIIQVFRDQLNHRAQEVIESDPMTDDMIYNAAYLIPWEQEPEFSQNVEAIDQQFGDRLRIRYNNLTAPYTFAQLV

SEQ ID NO: 128 - protein, 247 aa, Nostoc punctiforme ATCC 29133
MSFYIYGILTLPAPQNLNLEGLDRQPVQIKILDDFAVIYSEAQQERYLASRRNLLSHEKVLEEIMQAGDRYLLPVQFGLLVSSWETVSQQLIRPHQEELTQLLAKLSGCREVSVKVFWDTEAEIQGLLAEHPNLKTERDKLVGQPLSMERVIQIGQVIEQGMSDRKQGIIDVFKGTLNSIAIEVVENTPQVDTMIYNSAYLIPWEAESQFSEHVESLDRQFENRLRIRYNNFTAPYNFARLRLTTSN

SEQ ID NO: 129 - protein, 244 aa, Nostoc sp. PCC 7120
MSSGLYLYGIFPDPIPETVTLQGLDSQLVYSQIIDGFTFLYSEAKQEKYLASRRNLISHEKVLEQAMHAGFRTLLPLRFGLVVKNWETVVTQLLQPYKAQLRELFQKLAGRREVSVKIFWDSKAELQAMMDSHQDLKQKRDQMEGKALSMEEVIHIGQLIESNLLSRKESIIQVFFDELKPLADEVIESDPMTEDMIYNAAFLIPWENESIFSQQVESIDHKFDERLRIRYNNFTAPYTFAQIS

SEQ ID NO: 130 - protein, 264 aa, Octadecabacter antarcticus 307
MKREVVRMTDENTINSKYLYAIIKCREQREFIARGIGERGDAVHTIAYKGLAAVVSDSPVMEYDQSRRNMMAHTAVLEELMEEFTLLPVRFNTVAPEAGAIEERLLVPRHEEFTQLLGQIDKRVELGIKAFWHDGMIFEEVLRENDSIRKMRDALEGKSVDGSYYERIQLGEKIEQAMIKKRVEDEEIILSRIRQHVHKSRSNKTIGDRMVLNGAFLVDANKESDFDKAVQLLDQDLGNRLMFKYVGPVPPYNFVNIVVNWGVV

SEQ ID NO: 131 - protein, 356 aa, Octadecabacter antarcticus 307
MTVVAEENMTGSVGLYVCAIVAEWESNSALIKCANEAQGEIQLIGQGGITAVVMVPPEDQPVSRDRQELVRQLLVHQQLVERFTEIAPVLPVKFGTLAPDRESVELGLERGREKFFTAFGGLSGKTQFEITVTWDVADVFAKIAKLPAVVKLKVDLVATSESDRPINLDRVGRLVKETLDHQRAQTGKVLLDALLPLGVDSIVNPILNDSIVLNLALLVDTDQADALDRCLDELDSTFHGALSFRCVGPMPPHSFATVEINYIEPTQVSHACCVLELDAAHNFEEIRSAYHRLARQTQQDIAPDVVVDNKSSSVGIAVLNDAYKTLLSFVDAGGPVVVSVQRQEDAYATDIPSSGG

SEQ ID NO: 132 - protein, 257 aa, Octadecabacter arcticus 238
MTDEKKVNSKYLYAIIQCREPRELKARGIGERGDVVHTVVHKGLAAVVSDSPVMEYDQSRRNMMAHTAVLEELMEEFTLLPVRFNTVAPEAVAIEERLLVPRHDEFTQLLGQIDKRVELGLKAFWHDGMIFGEVLRENDSIRKMRDSLKGQSVDGSYYERIQLGEKIEKALTEKRLEDEEMILSRIRPHVHKSRSNKTIGDRMVLNGAFLVDAEKESKFDEAVQSLDQDLSDRLMFKYVGPVPPYNFVNIVVNWGES

SEQ ID NO: 133 - protein, 360 aa, Octadecabacter arcticus 238
MRAQKVIPAAEENISGNVGLYVCAIVAERVSCSALIQCANDAPGEIQLIGHGDFTAVVMVPEKDQLVSPDRKELMQQLLVHQQLIEKFMEIAPVLPVKFATLAPNRESVELGLEVGSEKFSAAFNSLSGKVQFEVIVTWDVAEVFAEIAKEPAVAKLKVDLAAMPESYGSVSLEQLGKLVKETLELRRAETGKVLLDALVQVGVDNVVNSILDDSIILNLALLVEAKRADAFDRCLDELDSTYHGALTFRCVGPLPPHSFATVEITYLEPAKVTEACDILELDVARSTEEVRSAYHRLARKSHPDIVPDVAVGETASVSMAVLTDAYKTLLSFVGAGGSVVVSVQRQEASYAADIISSAG

SEQ ID NO: 134 - protein, 258 aa, Pelodictyon phaeoclathratiforme
MDIETTKEGRYIYGIIRNSEFIDFGQIGIGKRNDRVYGVIYKDICAVVSSTPIIQYEARRANMIAHQKVLEEVMKRFNVLPVRFSTISPHDNDDAIIKILITDYSRFDELLIKMKGKKELGLKVMADETRIYENIIQKYDNIRSLRDKLLNQPADKIHYQRVKIGEMVADALKKEIESYKQQILDILSPIAEDIKITDNYGNLMILNAAFLIKEVKESEFDDSVNKLDEKYGNIMTFKYVGTLPPYNFVNLSINTKGV

SEQ ID NO: 135 - protein, 257 aa, Pelodictyon phaeoclathratiforme
MEKDGKYVYCIIASTYECNFGAIGIGGRGDLVNTIGFQGLSMVVSDHPLNHFVLNPDNILAHQRVIEVVMSQFNSVIPVRFGTVAATPDEIRNLLDRRYGELSELLERFENKVEYNLKASWRCMIDIYKEIDKEHVELKQLRREIEGLKDEEKRKLLIVEAGHIIENELQKKKEVEAYEIVTYLRKTVVAHKHNKTTGEAMFMNTAFLLNKGREVEFDNIMNDLGEQYKDRSDYYYTGPLPIFNFIDLRILPEKWEL

SEQ ID NO: 136 - protein, 339 aa, Pelodictyon phaeoclathratiforme
MDRQGIYIYGFIPNHYLTDIKTILIESGIYSIEYGSIAALVSDTMVDDIEYLNREDLAYLLVDHQKKIELIMSTGCSTIIPMQLGTIVNSGNDVIKIVKNGLRIINKTFDDIADIQEFDLVVMWNNFPDLIKKISDTPQIRIMKEEIANKGSYDQADSINIGKIIKKKIDEKNSKVNLDIMNSLSSLCICVKKHESMNDEMPLNSAFLIKKDKENSFIEMVNQLDIKYENLLRYKIVGPLPCYSFYTLESKLLNKKEIEKAEKILGIDAYKSESDIKKAYRAKAAHAHPDKNNTISAIDNDDFIEINKAYQILLEYSSVFKDSPDHKPDEPFYLVKIKK

SEQ ID NO: 137 - protein, 244 aa, Phormidium tenue NIES-30
MADRYYLYGIFPAPGPAELPLMGLDEQVVQAQQLGDFTFLYSLACQKRYLSSRKNLLGHEKVLEAAMEQGHRTLLPLQFGLIVESWNQVQEDLVTPYAEDLTQLFGRLNGCREVSIKVQWEPSTELEMMMAENADLRAQRDQLEGTQLGMEQVIFIGQQIESALEERKQGIVDQFRQALSPLAKDVLENAPQTDVMIYNAAFLIPWESEAEFSQAVDAIDSTFGDRLRIRYNNFTAPYNFAQLN

SEQ ID NO: 138 - protein, 245 aa, Planktothrix agardhii str. 7805
MGNGLYLYGILPTNRVRPLALHGLDKQPIQTHPVDEFSFLYSETQQERYLASRRNLLGHEDVLEKVMQHGYRSVLPLQFGLIVKDWDHVKAQLIIPYQDRLKELFHKLEGKREVGVKIFWEETEELDLLMTENQELREKRDSLEGKRLSMDEIIGIGQEIERAMQDRQQGIIDKFQQILNPLAQEIVENDNLTSAMIYNAAYLIPWDIEPQFGDKIEELDHHFNNRLRIRYNNFTAPFNFAQLNP

SEQ ID NO: 139 - protein, 268 aa, Psychromonas ingrahamii 37
MAENKKKVRKSSSKVIAKPKVIYAITAGGLQDLGNLVGINKSDIYTIEKESISFVVSDLSPSSPRPRPDRRNIMAHNEILKQLMSKTSVLPVRFGTVATGERAVNRFCSQYNAQLLEQLDRVQDRVEMGIKVTWNVPNIYDYFVDNHSELREERDRVYDGNKNPRRDDRINLGHMYDALVTEARLSHQTDLEEIILPGCDEIHSIPPKDEKVVVNLACLVQRADLEVFEERVVEAGKTLDNTYDIELNGPWAPHNFVELDLKTMTGRR

SEQ ID NO: 140 - protein, 273 aa, Serratia sp. ATCC 39006
MMSIDKSRNHRAKVLYALCVSDDSTPNYKIRGLEAAPVYSIDQDGLRAVVSDTLSTRLRPERRNITAHQAVLHKLTEEGTVLPMRFGVIARNAEAVKNLLVANQDTIREHFERLDGCVEMGLRVSWDVTNIYEYFVATYPVLSETRDEIWNGNSNANNHREEKIRLGNLYESLRSGDRKESTEKVKEVLLDYCEEIIENPVKKEKDVMNLACLVARERMDEFAKGVFEASKLFDNVYLFDYTGPWAPHNFVTLDLHAPTAKKKTLTRAGTLSD

SEQ ID NO: 141 - protein, 260 aa, Stella vacuolate ATCC-43931
MQTEALAPAAVAAEGKYLYCIIDAPAPATFASPGIGGRGDVVHTLAVGRLAAVVSDTPRIEYENSRRNMMAHTKVLEEVMAHHTLLPVCFGTVGSGDDVIAEKILEGRREELSRLLEEMRGRVELGLKATWREEVIFAEVLDEDPAVRKLRDSLVGRSPEKSHFERIRLGELIGQALLRKRRDEEERILDRVRPFVRKTKLNKPIGDRMILNAAFLVETAREAALDQSVREMDADWGARLSFKYVGPVPPYNFVTITIHW

SEQ ID NO: 142 - protein, 254 aa, Thiocapsa rosea strain DSM 235
MQQAKRQDVAAGRYIYAIIPDRGDHSLGRIGLDESEVYTIGDGRVAAVVSDLSGGRIRPQRRNMAAHQEVLKQVLREVSPLPAAFGLMADDEAAIIRILKDNQDAFLNQLERVDGSLEMGLRMSWDVPNIFEYFVGAHPELQELRDDFFRDGSNLTQDQMITLGRSFERLLEQDREEYTEQVESVMRSCCREIKRNKCRTEKEVLHLACLVDRDAAGRFEQVVLQAARPFDNNYAFDFNGPWAPHNFVEMDIHV

SEQ ID NO: 143 - protein, 244 aa, Tolypothrix sp. PCC 7601
MDAGLYLYGIFSDPIPPTVSLKGLDSQPVYSQVIEGFTFLYSDAKQEKYLASRRNLISHEKVLEQAMQEGFRTLLPLRFGLVVKNWETVISQLIQPCERQLRDLFQKLAGKREVSVKILWDTKAELQAMMQSNPDLKQKRDQMEGKNLSMEEVIEIGQLIESNLQQRKEAVIKTFFDELKPLAEEVVESEPMMEEMIYNAAFLIPWDQEALFSQRVEAIDKKFGDRLRIRYNNFTAPYTFAQIS

SEQ ID NO: 144 - protein, 266 aa, Trichodesmium erythraeum IMS101
MEFGFYVYGLIQEKGKMDESKDESKNGLKGSNESKDELKGLDKEDVKIQDVDEFAVLYSIAKKERYLASRRNLITHEKVLESAMEAGYRNLLPMQFGLVVSEWEKFSQDFTKPCEQQIHDLFTKLKNNREVGIKIYWEPDAELEKLLENDKDLKEERDSLKDKKLTMDQVIDIGQKIEQGMNERKQNIIEIFQETLNKMAIEVIENEVQTEKMIYNAAYLIPWDQEEDFGEKVETIDSKLCERGNFTIRYNSFTAPYNFARIRQQD

SEQ ID NO: 145 - protein, 334 aa, Ancylobacter aquaticus strain UV5
MTDLLVFAVVPADRFDPAILAEGDGLPPGLRAIAAGPLAAVVGAAPEGGLKGRERSALLPWLLASQKVMERLLANAPVLPVALGTVVEDEGRVRHMLDAGAAILGEGFQAVGDGIEMNLSVLWHLDTVVARLLPGVAPELRQAAAGGDAIERQALGVVLAGLVSAERRRARARVIEALQAVTRDFAIGEPTEPGGVVNLALLVDRAAEEALGAALEALDAEFDGALTFRLVGPLPPYSFASVQVHLSPAAAVCGARAALGVEPDASPETVKAAYRRAARETHPDLVPMGGEDEEAPEATADETSRFVVLSDAYRVLEGEHAPVSLRRLDSVLTE

SEQ ID NO: 146 - protein, 255 aa, Ancylobacter aquaticus strain UV5
MLYVYAITADYAAGANHLLPAKGIVPGVPVQRFGTGALGAVASPVPVTVFGKEALHALLDDADWTRARILAHQRVVSSLLPLATVLPLKFGTLVAGEASLAAALTSQHDALDATVARLRGAREWGVKLFFEAPTRTIRAEEPVGAGAGLAFFRRKKEEQETRAAAEAALDRCVAASHRRLASHARAAVANPLQPPELHGHPGTMGLNGAYLVAAENEAAWRVCFSELEQAYAALGARYVRTGPWAAYNFTGGGLV

SEQ ID NO: 147 - protein, 337 aa, Aquabacter spiritensis strain DSM 9035
MSGLLVFAIVPADRIEPGLLAPAEGLPPGLETVVAAGFAAIVGTAPEGGLKGRDRGSLLPWLLASQKVIERLMARGPVLPAALGSVLEDESRVRHMLVCGQAALAAAFETLNGCWQTDLSVRWDLSRTVAHLMTELPPGLRAAAETGDETARRSLGAALAGLVAGERRRIQSRIGAVLGAVARDLIVSDPVEPEGVVGVALLVDAPASAQVDAALDRLDGEFEGRLTFRLVGPLAPYSFATVQIHLGPAAGLAGAHAELGLEAGAPLEAVKAAYHRLIVGLHPDLVPHGSPGDDADDAASGKGGRAARFAAVTAAYRTLQAEHAPVSLRRQDGLSPG

SEQ ID NO: 148 - protein, 257 aa, Aquabacter spiritensis strain DSM 9035
MLYVYAITADHPGPHDAGSLPGEGIVPGAPVRLLPFGDLAAAVSPVSAVDFGPEALPARLQDVDWTGQRVLAHQRVVDSLVDVATVLPMKFCTLFSGAAALRAALADNRAALEATVVRLRGAREWGVKLFWEAPPAEPAPVERGPGAGAAFFQRKRDAQRLRAEAEAALAHGVAESHRRLAARARAAVANPVQPAAVHRRRGEMALNGAYLVPRADEAAWRESLAELERTYAGAGIRYELTGPWGPYNFTGGGLAGS

SEQ ID NO: 149 - protein, 334 aa, Bradyrhizobium oligotrophicum S58
MTMNLVGITTPDVAGAIAAAGGRLADVETRAVEAGGLVALLALSKAPFWHVLRRSRTALRSMLTAQRILEAAAVYGPLLPARPGTLIRNDAEACMLLRSQCRHLAEGLRLHGTSRQYQITISWDPVAALAARRDHQDLVEAAAASADGAADKAASMIQRFMSDQQARFEAEAMRALAAVAEDVITLPVNQPDMLMNAVVLLAPGAEPELERVLEALDRGLRGKNLIRLIGPLPPVSFAAVSIERPGRQRIAAARRLLGIGEATRTCDLRRAYLDKAHAHHPDTGGHAADASIVGAAAEAFRLLARVAEARASAGQDDVILVDIRRQDQQRSLST

SEQ ID NO: 150 - protein, 253 aa, Bradyrhizobium oligotrophicum S58
MSKANLGIGLVHGVVTAQSAALLPQIVDAFDATEIIVVNTEQQALLISDIPQYLRGHVEADTLFSDPARISTLAMKHHRILQAAAVVTDVVPVRLGTLVRGPSGARDLLNREAVRFAGHLVTIHNALEFSVRILPTEQPSRRVARPVPSSGRDYLRIRRDERCGQRPAVVDITLQELASRAVAIRERQSASRSGGRTPALAEAAFLVDRHALAAFDDCAGRIERQIAENGLALDIFGPWPAYSFVDGARENLG

SEQ ID NO: 151 - protein, 214 aa, Bradyrhizobium oligotrophicum S58
MSSPRLIGLLAADDVPADLADQIMSCGPVAAAIRFAPAAASSSESLDHHAAVVAWCRRAAFLPSRAGIPISPELLQSIARSAWYHRSTIEHIEGRVEISVELERRDGVRDGGIDGGGRAYLRATAHDLRACEVGVATAANLLAMYSERADADLIARTAPLPAIRLRASVLVRRAVAPRLARQFDSMLSAISDRLVCRVTGPWPPYSFSTIREPS

SEQ ID NO: 152 - protein, 252 aa, Burkholderia thailandensis sp. Bp5365 strain MSMB43
MVWLTYAVLTPKRSITLPPGVAGARLEIVDGAHLRTIVSEHPRAPSATIPSALDFGQTVAALFRHGAIVPMRFPTCLDSKQAVRDWLDDESDMYRDLLQRIDGCVEMGLRFRLPEAPRAQPRPQAGGPGHAYLAARGAPNSVARSHGERIAAVLRNLYRDWRFDGLVEGFVSLSFLVRQTTLDDFVDRCRQAARETAFPLYMSGPWPPYSFATDERSSAPEPHRALRLMRRPSTAVSISANVAAPEKKDSAR

SEQ ID NO: 153 - protein, 257 aa, Desulfobacterium vacuolatum DSM 3385
MTLHLLYCVFSSGEMEKTRKLVPPGIDGEPVHEICSNKISGVVSTLGKPPDTHVKSLLAYHGVIDSYHQNRTVIPMRFAAVFRTYAHMITALNNNEKSYLLQLKRLHDCTEMCVRFISNSPCCVKKKEPAISPKKISGTTFLQQRKAMYEQQNRLPPEIHEKTRDILQHFRGLYMEFKQESQPLEKDCPSLSLQGAEKTDGNALLISLFFLISKKNISLFRSRFQNICGSSSGRHMMNGPWPPFNFINTESNLTDPS

SEQ ID NO: 154 - protein, 265 aa, Desulfomonile tiedjei DSM 6799
MLGSLAAIQFLSISSYGADEMKFLMYCIFTENSIEPPHSLVGVNRSPVRIISCDGLAAAVSVITQKEIPRDPATGLDYHKVIQWFHERIGVIPLRLGTCLGHESDVVQLLHSHGARYKSLLKELDGCVEMGIRVIHDRPGPQELASKSPFISRFNGTESGTDYLMRRKVLFDADEFAISRNREIVERYHSPFTGLYVSFKAQTSKFSPLGTDRNSVLTSLYFLIPRQSADSFRAIYGDLRSGLHERIMLSGPWPPYNFVLPEDCL

SEQ ID NO: 155 - protein, 279 aa, Enhydrobacter aerosaccus strain ATCC 27094
MEGHRIYIYGIVRDAADGGPAPVPPVAGLDGGALRAIAGYGLAAIASAVDLSKAGIPFEEQLKDPDRATALVLEHHRVLQQAIDAQTVLPMRFGALFQDDRGVTDALEKNRCGLMDALGRIDGAREWGVKIFCDRAVAARQLSATSAVVQAAEKELSGLAEGRAFFLRRRLERLRTEETDRAVAHEVDVSRQALCELARASAPLKLQPAAVHGRGEDMVWNGAFLVPRSGEERFLSRLEVVVQSRSDLGLHYEVTGPWPPFSFVDGQLEGGGDACPDGA

SEQ ID NO: 156 - protein, 278 aa, Octadecabacter antarcticus 307
MRSATSIVYAYGVLTNCSDIALDMPRSDLAGLVKNGPLRILPFGNIAAVVCDFVLPNGSDLETLLEDSRSAERLILNHHQVLSYIVSQHTILPLRFGAAFTEDAGVIAALGGRCSELQKALGRIDGALEWGVKTFCDRKLLKQRVRGTGSEISDLESEIAKQGEGKAFFLRRRKERLILEEVEEILEQCVVGTQEQLEPSVIEEALVKLQPPTVHGHEHDMLSNISYLIARGTEDAFMQSLEDLRLAHAPYGLEYQMNGPWPAYSFSDQQLEGGVNDQ

SEQ ID NO: 157 - protein, 278 aa, Octadecabacter arcticus 238
MSSATSIVYVYGVLTNCSDLVLDFPPGDLAGIVESGPLRILPFGDIGALVCDFILPDGSDLKTILEDSRSAERMILNHHLVLADMVSRYTILPLRFGAVFAEDAGVIAALGGRYSTLQKELDRIDGAIEWGVKSFCNRKMFSECVAETVSEISVLEKEIADQGEGKAFFLRRRIQRLILDEVEKTLEQCLVGAQDQLKSRAIEETLVKLQPPTVHGHKHEMVSNRSYLIARGAEDAFMQSLDDLRVVYAPFGFDYQINGPWPAYSFSDQQLGGGVNDK

SEQ ID NO: 158 - protein, 261 aa, Rhodobacter capsulatus SB 1003
MGHYLYGLLAPPARGTLAQMQAAAAGVTSLGGPVALSAVEGMLLVHCPCDLAEISQTRRNMLAHTRMLEALMPLATCLPVRFGVIAQDLAEVARMIHERRAELVGHAQRLLDPVEIGLRVRFPRDRALAQLMAETPDFVAERDRLMGQGAGAHFARADFGRRLAEALDARRTRDQKRLLAALRPHVRDHVLRAPEEDVEVLRAEFLIPAAGVDAFSRIAHDLAAALGFAGAAEPELQVIGPAPPYHFLSLSLAFDNTSEAA

SEQ ID NO: 159 - protein, 316 aa, Rhodobacter capsulatus SB 1003
MAHEIIAILPCEAAQLPSGLTGVVGRGATAVLAPAPGWAERLTGGPKQTAVRHHSRLEALMAMGSVLPFAAGIACTPEEAALLLRLDAPLIARLAAEIGPRRHFQLALDWDESRVLAAFRDSPELAPLFSGAAVTPEALRQAITALADRLSATALRLLDPVAEDPVEQPRAPGCLLNLVFLLRPEDEPRLDAALQAIDALWSEGLRLRLIGPSAPISHALVDIDRADVAALAAAADLLKVAPEAGPEAVTEAAKAALRSPDLAANAAEQIRAAARLLLRAGDIAALGLSGAATLPHLVHLRPGGRKSGLTSSGEAA

SEQ ID NO: 160 - protein, 231 aa, Rhodobacter capsulatus SB 1003
MTGLALHGFVSPDGWSAAAAPPARCAVVLGGVAALVSEAGDALDTPETAQAAALAHHALISAWHRRGPVLPVRLGTVFSSQAALQTALAPKAAQLRAALDALADKEEMVLTIVPAARPPDLPPPAATGADWLRARKAVRDRGQARQTDRQQTLAGLQDALRAQGVASLAAPAPREGGSRWHLLIARDDGAGLDRWLAAQADRFDAAGLDLTLDGPWPPYRFAAEILEALDG

SEQ ID NO: 161 - protein, 220 aa, Rhodobacter capsulatus SB 1003
MSEPRISGLAPWRADLPDVIGCHGGWVLMGAAADETPEARLRRQVGWCRAAVDVLPLSPRLAPTRAEAERLVATRGPDLERAHRHIRGRLQVIVQLEMCRTDLGLVRREISGGRSWLQDRAERATREARANADFEAQVRRVVRALFPREGQVVTLAPSGTAGQLRLRRAVLVPRAGLQAFAAALSADLDRDGRGGLWDVIAPLPPLAFAALEAGPGGAVT

SEQ ID NO: 162 - protein, 254 aa, Rhodobacter sphaeroides 2.4.1
MIYLYGLLEEPASGHEVLAGMAGVTGPIALARLPGGILIYSSATEADILPRRRLLLAHTRVLEAAAWFGNLLPMRFGMMASTLAEVAAMLASRLTELCAAFDRVRGRVELGLRLSFPREPALAATLATAPDLAAERARLLALRRPDPMAQAEFGRRLAERLDARRGETQRLLFQSLRPLWVDHRLRVPDSDVQVIAVDVLVEDGAQDRLAAALVKAAADCSFAPTAEPSVRVIGPVPLFNFVDLVLSPRREEVA

SEQ ID NO: 163 - protein, 291 aa, Rhodobacter sphaeroides 2.4.1
MRLREVVAVLEGHPPSVLPEGTEAICEAGLTAILGMPPGLLSGRRALLEHAACRQAVLERLMAFGTVLPVLTGNCLTPAEAAAALAANSPRLRQELRRLAGRVQFQVLVQWHAALVPKRTDPDETAEDLRLRFTHRIADALARVAERHVNLPLREDMLANQALLLLQTRTDDLDRSLEQIDALWTEGLRIRRIGPSPPVSFASLNFRRVSSAAIRRARHRFDLEGPVDPIRLRALRRDLLLRASEAERAEILAAAAVLDLLTRCAASGGDLHLVRIWSEGQAVPSDLEDAA

SEQ ID NO: 164 - protein, 232 aa, Rhodobacter sphaeroides 2.4.1
MSGLLLLGVVSGLGISPAITSPHLRLDGDGYAAILLSLDRLPPDPASPDWAVQAALAQNAILSAYAATEDVLPVALGAAFTGIAAVKRHLDAERATLDAGMERLAGRAEYVAQLIAEQVADGAAPAPASGSAFLKARSARHEQRRHLARERTGFARATAEELASLSCSASARPLKPDGPLLDLSLLVARDRVPGLLEAAEASSRAGSRLALSVRLIGPCAPFSFLPETRGHD

SEQ ID NO: 165 - protein, 169 aa, Rhodobacter sphaeroides 2.4.1
MAGDARSRVRLHLAAMRDCETFLPFPPAATIAVDEAIAWCGRRTNALAEEIDRFSRQRQLTVSARLIAPLLPDAAASGAGWLRARRDASAHQARLRTVLMQIMSLLGEVRCIPGRLQDEVQVNLLVPAAETHPVLHELRERLRVGDALWSACTVTGPWPPYAFISWETA

SEQ ID NO: 166 - protein, 260 aa, Rhodococcus hoagie 103S
MSEQESAPDGGGPVVYVYGLVPADVEVKEDATGIGSPPRPLKIVHHEDVAALVSEIDPDTPLGSSDDLRAHAAVLDSTATVAPVLPLRFGAVLTDTDAVVAELLEPYRDEFHEALEQLEGKVEFVVKGKYVEDAILREILADDPEAARLRDVVREQPEDTTRDERLALGERISQALTAKREQDTGRIVEALQPAATAVAPREPTDDEEAGSVAVLISADGVDELDKAVARLIDDWQGRVEVTVTGPLAAYDFVKTRAPGT

SEQ ID NO: 167 - protein, 259 aa, Rhodococcus hoagie 103S
MTPDDGVWVYAVTGDGSFPGGISGIRGVAGEELRTVTDSGFTAVVGTVRLDTFGEEALRRNLEDLDWLADTARRHDAVVAAICAGGATVPLRLATVYFDDDRVRTMLRDNAEQLGEALQQIADRSEWGVRAYLERPRSEPRDAREKTGRPSGTAYLMQRRAQVAAREQAESAAGRRADEIFAELARWAVAGVRQPPSPPDLAGRRSQEILNTSFLVDNGRHREFVTAVEELDARLSDVDLVLTGPWPPYSFTSVEASAR

SEQ ID NO: 168 - protein, 222 aa, Serratia sp ATCC 39006
MSLLLYGIVAEDTQLALEPDGSPHAGEEPMQLVKAATLAALVKPCEADVSREPAAALAFGQQIMHVHQQTTIIPIRYGCVLADEDAVTQHLLNHEAHYQTQLVELENCDEMGIRLSLASAEDNAVTTPQASGLDYLRSRKLAYAVPEHAERQAALLNNAFTGLYRRHCAEISMFNGQRTYLLSYLVPRTGLQAFRDQFNTLANNMTDIGVISGPWPPYNFAS

SEQ ID NO: 169 - protein, 362 aa, Stella vacuolate ATCC-43931
MSGLLVFAIVPADGIEPGILAPREELPANLRAVAADGFAAVVGAAPEGGLKGRDRSVLLPRLLASQKVIERLMARGPVLPVTLGTVLEDEARVRHMLAAGAPMLEAAFGTLGDCWQMDLSVRWDLNQVVARLMGEVPGDVRAAAGSGDEAARRALGEALAGLAAGERRRVQSRLAAALRDVARDLIVSEPVEPESVVDIAILVERPALAEVEAALDRLDAEFEGRLKFRLVGPLAPHSFATVQVHLAPEAALAGACAELGVERGAGLQDVKVAYHRALVRFHPDLAPHGDDGGPEDEHDGGEGRASRLLTVTAAYRALQAEHAPISLRRQDGIAVNQEQDASAAMGQQRGIVPGRELQALRM

SEQ ID NO: 170 - protein, 258 aa, Stella vacuolate ATCC-43931
MLYVYAIAADHPDPDNAMFGGEGIVPDAPVRLLQLGDLAVAASLVSAADFAADALRAHLEDARWTALRVLAHQRVVDSLLPHATVLPMKFCTLFSGEAALKQALAHNRAALQATVERLRGAREWGVKLYWEAPRNPAPPSAGQGEAGAGAAFFQRKRDQQRQRAEAEAAVARCVAASHRRLADAARAAVANPVQPPAVHRQPGEMALNGAYLVARAAEPAWREVLAELERTHADGGIRYELTGPWGPYNFTGSGLVGS

SEQ ID NO: 171 - protein, 253 aa, Thiocapsa rosea strain DSM 235
MSDRPRPMLHCILRSPPGSIARAEAGLRWIERDGLAALVADREPSEIAGASSVGLQRYADIVAEIHACAAVIPVRFGCLLAGDEAVGKLLHRSRDRLHGLLDQVGDCLEFGIRLLLPADAPAATDDDAAPRLHANAPSDPRADPDMGPGLSHLLAIRHRLDVEASLAARAREAREVIKGRVAGRFREVREELGQIDGRSLLSLYFLVPREQGEHFVECLRQDASSLRGTGLLTGPWPPYNFVGAIDDDIRSLD

SEQ ID NO: 172 - protein, 119 aa, Anabaena-flos-aquae
MLTKLLLLPIMGPLNGVVWIAEQIQERTNTEFDAQENLHKQLLSLQLSFDIGEIGEEEFEIQEEEILLKIQALEEEARLELEAEQEEARLELEAEQEDFEYPPQFTAEVNKDQHLVLLP

SEQ ID NO: 173 - protein, 88 aa, Bacillus-megaterium
VLHKLVTAPINLVVKIGEKVQEEADKQLYDLPTIQQKLIQLQMMFELGEIPEEAFQEKEDELLMRYEIAKRREIEQWEELTQKRNEES

SEQ ID NO: 174 - protein, 83 aa, Ancylobacter aquaticus strain UV5
MGMLTDVVFAPAVGPLKGVLWLARIIAEQAERTLYDEGVIRAALLDLEQQLEAGEIDEDAYETQETVLLERLKIARERMRSGL

SEQ ID NO: 175 - protein, 122 aa, Aphanizomenon flos-aquae NIES-81
MLTKLLLLPIMGPLNGLVWIGEQIQERTNTEFDAQENLHKQLLNLQLSFDIGEISEEDFEIQEEELLLKIQALEEEARLELELAEEEARLELELEQEEEEDFVVKPQLTTEIDRDKDLVLLP

SEQ ID NO: 176 - protein, 86 aa, Aphanothece halophytica strain PCC 7418
MVFKLLLLPITGPIEGVTWLGEQILERANQELDEKENLNKRLLSLQLSLDLGEISEEEYDEQEEEILLAMQAMEDEENNQAEEETD

SEQ ID NO: 177 - protein, 83 aa, Aquabacter spiritensis strain DSM 9035
MSLVTDVLFAPAVGPLKGVLWLARLIAEQAERTLYDEDVLRAALLDLEQRFEAGEISEADYETEEDILLARLKIARERMRSGL

SEQ ID NO: 178 - protein, 82 aa, Bradyrhizobium oligotrophicum S58
MLFQILTSPVSGPFRMVSWIGGAIRDAVDTKMNDPAEIKRALAALEQQLEAGSLSEQDYERMEMELIERLQSSLRHGSGNGG

SEQ ID NO: 179 - protein, 75 aa, Burkholderia thailandensis sp. Bp5365 strain MSMB43
MFILDNLLAAPIKGMFWIFEEIAQAAEEETIADIEMIKAALVELYRELESGQIDETEFETRERALLDRLDSLETS

SEQ ID NO: 180 - protein, 78 aa, Chlorobium luteolum DSM 273
MFILDDILLAPLSGMVFLGRKINEIVQNEMSDEGAVKEQLMKLQFRFEMDELSEEEYDRLEDELLSTLAEIRAQKENR

SEQ ID NO: 181 - protein, 83 aa, Dactylococcopsis salina PCC 8305
MVFKLLLLPITGPIEGITWLGEQILERADQELDSKENLNKRLLSLQLSLDLGEISEEEYDEQEEEILLAMQAMEDEENEEEES

SEQ ID NO: 182 - protein, 77 aa, Desulfobacterium vacuolatum DSM 3385
MFLVDDILFFPAKSLVWVFRELHNAVQQEKTNESDALTTELSELYMMLETGKITEEEFDEREEQILDRLDEIQERDQ

SEQ ID NO: 183 - protein, 86 aa, Desulfomonile tiedjei DSM 6799
MERYTMFLLDDILFLPMNGVLWICNEIHDAAEQELHNESDAITAQLQKLYTLLEAGDIGESEFDVLEAELLDRLDAIQERGALLEA

SEQ ID NO: 184 - protein, 83 aa, Desulfotomaculum acetoxidans DSM 771
MLGKLLLSPILGPVMGVKFIAEKIKQQADQELYDKSKIKQDLMELQIKLELEEITEEYYLQREEELLVRLDELASMETEEEEV

SEQ ID NO: 185 - protein, 129 aa, Dolichospermum circinale
MLTQLLLLPIMGPLNGVVWIAEQIQERTNTEFDAQENLHKQLLSLQLSFDIGEISEEEFEIQEEEILLKIQALEEEARLELEAEQEEARLELEAEQEQARLELEAEQEELENQPQLTPKIDTYRHLVKL

SEQ ID NO: 186 - protein, 81 aa, Enhydrobacter aerosaccus strain ATCC 27094
MGMLARLLTLPVSAPVGGVLWIARKIEEEANAERWDRNKITGALSELELELDLGAIDVEEYDAREAVLLQKLKELQEVEND

SEQ ID NO: 187 - protein, 103 aa, Isosphaera pallida ATCC-43644
MFLVDDILLAPAHSLMFLLREIHQAALEELRRDAQKVREELAECYRALETGALTDEEFASLETDLLDRLDALEELARFNSDEDDDPEDEDWDVEDDDPAEAVW

SEQ ID NO: 188 - protein, 77 aa, Legionella drancourtii LLAP12
MLLLGSILMAPVHGLMAIFEKIKEAVDEEKQHDIERIKSELMALYTKLESGELSEADFEKQEKILLDKLDSLEDEDD

SEQ ID NO: 189 - protein, 86 aa, Microcystis aeruginosa NIES-843
MFLDLLFLPVTGPIGGLIWIGEKIQERADIEYDEAENLHKLLLSLQLSYDMGNISEEEFEIQEEELLLKIQALEEEEAENESESSL

SEQ ID NO: 190 - protein, 84 aa, Nostoc punctiforme ATCC 29133
MVLRFLLLPITGPLMGVTWLGEKILEQASTEIDDKENLSKQLLALQLAFDMGEIPEEEFEIQEEALLLAILEAEQEERDQTQEY

SEQ ID NO: 191 - protein, 125 aa, Nostoc sp PCC 7120
MLGKILLLPVMGPINGLMWIGEQIQERTNTEFDAQENLHKQLLSLQLKFDMGEISEEEFDIQEEEILLKIQALEAEERLNAESEEDDDLDVQPIFILASEENPVYQDQSRFSEEYEDKEDLVLSP

SEQ ID NO: 192 - protein, 84 aa, Octadecabacter antarcticus 307
MGIILNTLMSPLIGPMKGVFWVAEQIKDQTDAEIYDDSKILVELSELELLLDLEKIELKDFEAKEDVLLKRLQEIRKAKKNDSV

SEQ ID NO: 193 - protein, 84 aa, Octadecabacter arcticus 238
MSIILNTLMGPLIGPMKGLLWVAEQIKDQADAELYDDSKILVALSELELSFDLEQIELKEFEAQEDVLLQRLQAIRKAKQNDTD

SEQ ID NO: 194 - protein, 78 aa, Pelodictyon phaeoclathratiforme
MFILDDILFAPLNGLIFIAKKINDVVEKETSDEGVVKERLMALQLRFELDEIDEVEYDREEDELLQKLERIRLNKQNQ

SEQ ID NO: 195 - protein, 81 aa, Phormidium tenue NIES-30
MLFKLLFAPVLGPIEGISWVANKLLEQADVPTNDLESLQKQLLALQLAFDMGEVAEADFEIQEEEILLAIQAIEDEEDEDE

SEQ ID NO: 196 - protein, 85 aa, Planktothrix agardhii str. 7805
MILRLLLSPITAPFEGVIWIGEQLLERAEAELDDKENLGKRLLALQLAFDMGDIPEEDFEVQEEELLLQIQALEDEANQENDEID

SEQ ID NO: 197 - protein, 149 aa, Psychromonas ingrahamii 37
MFILDDILLAPYSGIKWLFKEIQRQAQEELDGEADRITTDLTNLYRQFESNEITEQEFEERETVLLDRLDELQEESNLLDEEYDEEYEDDDEEYEDDDEEYEDDDEEYEDDDEEYEDDDKNDKDKNDDHDNDDDDENKDENDKYNDEER

SEQ ID NO: 198 - protein, 85 aa, Rhodobacter capsulatus SB 1003
MGLLRKLLLAPVELPITGALWIVEKIAETAESELTDPGTVRRLLRGLEQQLEAGEITEEEYEFAEEILLDRLKRGQAAEARSGGP

SEQ ID NO: 199 - protein, 77 aa, Rhodobacter sphaeroides 2.4.1
MGLLTSLLTLPFRGPFDGTLWIAARIGEAAEQSWNDPAALRAALVEAERQLLAGELSEETYDAIELDLLERLKGTAR

SEQ ID NO: 200 - protein, 83 aa, Rhodococcus hoagie 103S
MGLFSAIFGLPLAPVRGVVWIGEVVRRQVEEETTSPAAMRRDLEAIEEGRRSGEISEDEAAQAEDEILHRVTRRRDAGASGEE

SEQ ID NO: 201 - protein, 138 aa, Serratia sp ATCC 39006
MLLIDDILFSPVKGVMWIFRQIHELAEDELAGEADRIRESLTDLYMLLETGQITEDEFEQQEAVLLDRLDALDEEDDMLGDEPGDDEDDEYEEDDDEEDDDEEDDDDEDDDDEDDDDEEDDDDDEDDDDEDEPEGTTK

SEQ ID NO: 202 - protein, 83 aa, Stella vacuolate ATCC-43931
MGLVTNVAFAPVVGPLKGVLWLARLIADQAERTLYDEDLVRAALLDLEQRLDAGQISEADYDAEEEILLARLKIARERMRSGL

SEQ ID NO: 203 - protein, 98 aa, Thiocapsa rosea strain DSM 235
MLIVDDLLAAPFKGIIWVFEEIHKSATAEQRARRDEIMAALSALYRALEQGEITDDTFDTREQALLDELDALDAREDANELGSDEDEDDLDGAGEDAS

SEQ ID NO: 204 - protein, 132 aa, Tolypothrix sp PCC 7601
MEVMIMLGKILLFPVMGPISGLMWIGEQIQERTDTEFDAQENLHKQLLSLQLSFDIGEISEEDFEEQEEELLLKIQALEEEKARLEAESIEDEEDEVEPTYFIAEVEEDKVLAEAFRGNKKYEDNENLVLSP

SEQ ID NO: 205 - protein, 85 aa, Trichodesmium erythraeum IMS101
MLLRLLTLPISGPLEGVTWLGKKLQEQVDTEIDETENLSKKLLTLQLAFDMGEISEEDFEDQEEELLLAIQALEEQKLKEEEEDA

SEQ ID NO: 206 - protein, 248 aa, Anabaena-flos-aquae
MLPTRPQTNSSRTINTSTQGSTLADILERVLDKGIVIAGDISISIASTELVHIRIRLLISSVDKAKEMGINWWESDPYLSTKAQRLVEENQQLQHRLESLEAKLNSLTSSSVKEEIPLAADVKDDLYQTSAKIPSPVDTPIEVLDFQAQSSGGTPPYVNTSMEILDFQAQTSAESSSPVGSTVEILDFQAQTSEESSSPVVSTVEILDFQAQTSEESSSPVGSTVEILDFQAQTSEEIPSSVDPAIDV

SEQ ID NO: 207 - protein, 100 aa, Bacillus-megaterium
MAVEHNMQSSTIVDVLEKILDKGVVIAGDITVGIADVELLTIKIRLIVASVDKAKEIGMDWWENDPYLSSKGANNKALEEENKMLHERLKTLEEKIETKR

SEQ ID NO: 208 - protein, 120 aa, Ancylobacter aquaticus strain UV5
MNEQRMEHSLQAVGLADILERVLDKGIVIAGDITISLVEVELLNIRLRLVVASVDRAMSMGINWWQSDPHLNSHARELAEENKLLRERLDRLEAAVVPSALPADAALEPSLAGEDARHGG

SEQ ID NO: 209 - protein, 72 aa, Ancylobacter aquaticus strain UV5
MPSRHSGEIAVADLLDRALHKGLVVWGEATISVAGVDLVYLGLKLLLTSTDTVNRMREAANAPPDERHLHAD

SEQ ID NO: 210 - protein, 157 aa, Aphanizomenon flos-aquae NIES-81
VTSTPILPTRPQTNSSRAINTSTQGSTLADILERVLDKGIVIAGDISISIASTELIHIRIRLLIASVDKAKEMGINWWETDPYLSTKAQRLVEENQQLQNRLENLESQINLLTSAKVQEQISLVETTEDNTHQTTEDNTHQTHEESIPLPIDSQLDV

SEQ ID NO: 211 - protein, 128 aa, Aphanothece halophytica strain PCC 7418
MVNPNTNKPKSYQSKGITNSTQSSSLADILERVLDKGIVIAGDITVSVGSTELLSIRIRLLVSSVDKARELGINWWEGDPYLSSQANLLKEENQALQNRLENMEAELRRLKGETNPEPSFLSESEDNS

SEQ ID NO: 212 - protein, 114 aa, Aquabacter spiritensis strain DSM 9035
MSEQRMEHSLQAVGLADILERVLDKGIVIAGDISISLVEVDLLNIRLRLVVASVDRAMSMGINWWQSDPHLNSHARQLEEENRLLRERLDRLEAALAPPEGGMLRAEVEVAHGG

SEQ ID NO: 213 - protein, 78 aa, Aquabacter spiritensis strain DSM 9035
MPDPEPIIPRTSGDVALADLLDRALHKGLVLWGEATISVAGVDLVYLGLKVLLASTDTANRMRDAAAASAAGSHLPGG

SEQ ID NO: 214 - protein, 127 aa, Arthrospira platensis NIES-39
MTLQSRSSSPQRGVPMSTSGSSLADILERVLDKGIVIAGDISVSVGSTELLSIRIRLLIASVDKAKEIGINWWESDPYLSSQAQQLSQSNQQLLEEVKRLQEEVRSLKALTSQSSQPVTPPNSENDD

SEQ ID NO: 215 - protein, 119 aa, Bradyrhizobium oligotrophicum S58
MTFTVHQPTGGDRLADILERVLDKGIVVAGDVTISLVGIELLNIKIRLIVATVDRALELGINWWEADPRLTTRASELSVENEELKKRLALLEADAGRNQRPRKRRVRSIAATSGASHER

SEQ ID NO: 216 - protein, 81 aa, Bradyrhizobium oligotrophicum S58
MTYRADLDYLEPAASSEGSLLELLDHLLDRGVLLWGELRISVADVELIEVGLKLMLASARTADRWRQTTTQRASIAPGDCP

SEQ ID NO: 217 - protein, 74 aa, Burkholderia thailandensis sp. Bp5365 strain MSMB43
MRSADGEPVSAELAQRLSLCESLDRILNKGAVISAQVVVSVADVDLLYLHLRLLLTSVETALVGRAMPREEASR

SEQ ID NO: 218 - protein, 89 aa, Burkholderia thailandensis sp. Bp5365 strain MSMB43
MADLLERVLDKGVVITGDIRINLVDVELLTIRIRLLVCSVDKAKELGIDWWNADTFFLGPDRGQSALPGRASAVDVAAGSAVHADAAHR

SEQ ID NO: 219 - protein, 97 aa, Chlorobium luteolum DSM 273
MPELKHAVNATGLADILERVLDKGIVIAGDIKIQIADIDLLTIKIRLMVASVDKAIEMGINWWQEDPYLSTGAKTSEQTRLLGEINQRIEKLESINR

SEQ ID NO: 220 - protein, 69 aa, Chlorobium luteolum DSM 273
MQEDLYTANRQVTLLDILDRVLNKGVVISGDIIISVAGIDLVYVGLRVLLSSVETMERLDAARAEGLQQ

SEQ ID NO: 221 - protein, 68 aa, Chlorobium luteolum DSM 273; identical to SEQ ID NO: 102

SEQ ID NO: 222 - protein, 68 aa, Chlorobium luteolum DSM 273; identical to SEQ ID NO: 102

SEQ ID NO: 223 - protein, 130 aa, Dactylococcopsis salina PCC 8305
MVNSNTNQPKSYQSKGITNSTQSSSLADILERVLDKGIVIAGDISVSVGSTELLTIRIRLLISSVDRAREIGINWWESDPYLSSQAHLMKEENQALQSRLENMEAELRRLKGETNLDQSSLGESDQRSLQ

SEQ ID NO: 224 - protein, 74 aa, Desulfobacterium vacuolatum DSM 3385
MAYIDIDNDASKQISICEALDRVLNKGAVITGELTISVADIDLIYLSLQAVLTSVETARHMFDSQINDAVKEVK

SEQ ID NO: 225 - protein, 105 aa, Desulfobacterium vacuolatum DSM 3385
MPIQRTAQHSIESTNIADLLERVLDKGIVIAGDIKISLVDIELLSIQLRLVICSVDKAKEMGMDWWVNNPVFMPNKGTQNDEIADTLTKINSRLEHLEKATISGS

SEQ ID NO: 226 - protein, 73 aa, Desulfomonile tiedjei DSM 6799
MMDEEEHVSLCEALDRVLNKGAVIAGEVTISVANVDLIYLGLQVVLASVDTIRGKRNELLRHDVGLHLTADNA

SEQ ID NO: 227 - protein, 81 aa, Desulfomonile tiedjei DSM 6799
MSIQASTRHSIQSTNLADLLERVLDKGVVIAGDIKIKLVDVELLTIQIRLVVCSVDKAKEMGMDWWTNNPAFQPALAQISE

SEQ ID NO: 228 - protein, 123 aa, Desulfotomaculum acetoxidans DSM 771
MGPQMGPIKSTGNLSLLDVIDRILDKGLVINADISVSIVGVELLGIKIKAAVASFETAAKYGLQFPTGTEINEKVSEAAKQLKEICPECGKKSGRDELLHEGCPWCGWISARALRLETEHSQR

SEQ ID NO: 229 - protein, 78 aa, Desulfotomaculum acetoxidans DSM 771
MLPIREERATLTDLLDRVLDKGLLLNADILISVAGVPLIGITLKAAIAGMETMKKYGLLIDWDQESRLAERRLRSSRH

SEQ ID NO: 230 - protein, 108 aa, Enhydrobacter aerosaccus strain ATCC 27094
MAVTNGRMEHSIQGSSLADILDRILDKGIVIAGDVTISLVGVELLNIRLRLLVASVDKAIEMGINWWEADPYLTSQTKASSEQTELLQQRLERIEGLLAGQATKEQPL

SEQ ID NO: 231 - protein, 74 aa, Enhydrobacter aerosaccus strain ATCC 27094
MPVQTAHDGELALADLLDRALNKGVVLWGDATISLAGVELVYVGLRVLVASCSTMEKYRSSPRKGSMPIARGES

SEQ ID NO: 232 - protein, 98 aa, Isosphaera pallida ATCC-43644
MIVCSSSTPERIGPPMNLPPPHHAPWCYDSPDLETLPLDPAERIALCEVLDRVLNKGVVIHGEITISVAGVDLVYLGLNLLLTSVETAQSWKFRGMIE

SEQ ID NO: 233 - protein, 171 aa, Isosphaera pallida ATCC-43644
MAITRSSRPDVTHSTSGATLADVLERVLDKGLVIAGDIKIKLVDVELLTIQIRLVVASVDKAREMGLDWWTRSPELSSLAATTCPALTPPKQEATPPATRIQAPTESAQTTPDQSHPSDPSASNIDEVAELRRHIELMQLRDEARQRAHREELAALRAQLTRLTELLDSPR

SEQ ID NO: 234 - protein, 61 aa, Legionella drancourtii LLAP12
MIIEDKPVSLCETLDRVLNKGVVVAGTVTISVADVDLLYLDLHCLLSSMKGMNLIGSERER

SEQ ID NO: 235 - protein, 106 aa, Legionella drancourtii LLAP12
MELQKSPTHSIGSTTIADLLERILDKGIVIAGDIKVNLVQVELLTIQIRLLICSVDKAKEIGMDWWTHQNDVQSKNGSMPIQEYVTQMEERLKNLENTLASSKNAI

SEQ ID NO: 236 - protein, 114 aa, Lyngbya confervoides BDU141951
MTGQSLSRSSSANRQMATATQGSTLVDVLERVLDKGIVIAGDISVSVGSTELLTIRIRLLVASVDKAREMGINWWENDPYLSARSQELLTANEQLQSRIESLEQELKSLRSQED

SEQ ID NO: 237 - protein, 136 aa, Microcystis aeruginosa NIES-843
MTSSTFAGSLRNQSNNSLKTATQGSSLADILERVLDKGIVIAGDISVSIASTELINIRIRLLIASVDKAREMGINWWEGDPYLHSQSQALLAENRELSLRLQTLETELETLKSLTQLSAMESHDTSPNDEAHSSDA

SEQ ID NO: 238 - protein, 116 aa, Nostoc punctiforme ATCC 29133
MSTNTNRGAITTSTQGSTLADILERVLDKGIVIAGDISISVGSTELLNIRIRLLISSVDKAKEIGINWWESDPYLNSQTRTLLATNQQLQERLASLETELQSLKALNPINHQNAGD

SEQ ID NO: 239 - protein, 148 aa, Nostoc sp PCC 7120
MTTTPIHPTRPQTNSNRVIPTSTQGSTLADILERVLDKGIVIAGDISISIASTELIHIRIRLLISSVDKAREMGINWWENDPYLSSKSQRLVEENQQLQQRLESLETQLRLLTSAAKEETTLTANNPEDLQPMYEVNSQEGDNSQLEA

SEQ ID NO: 240 - protein, 112 aa, Octadecabacter antarcticus 307
MNDGKMEHSLNATNLADILERVLDKGIVIAGDVTISLVGVELLNIKLRLLIASVDKAMEMGINWWAHDPFLTAGAQAPAVADPAMLERMDRLEAALATALASNQTTPMKGHK

SEQ ID NO: 241 - protein, 74 aa, Octadecabacter antarcticus 307
MTNKAQGGQDLALADLLDRALSTGVVIWGEATISLAGVDLVYVGLKVLVASVDAAERMKAASLVDRPTDRGQQI

SEQ ID NO: 242 - protein, 113 aa, Octadecabacter arcticus 238
MNNGKMEHSLDATNLADILERVLDKGIVIAGDVTISLVGVELLNIKLRLLIASVDKAMEMGINWWAHDPYLTAGAQAPVGVDPAMLERMDRLEAALAKALASNQTTPAEGQSS

SEQ ID NO: 243 - protein, 72 aa, Octadecabacter arcticus 238
MTNETQGGQDLALADLLDRALSTGVVIWGEATISLAGVDLVYVGLKVLVASVDAAQRMKDASLVDRPTDGGQ

SEQ ID NO: 244 - protein, 99 aa, Pelodictyon phaeoclathratiforme
MPELKHAVNATGLADILERVLDKGIVIAGDIKIQIADIDLLTIKIRLLIASVDKAMEMGINWWQEDTYLSTKAKDKEQQLLRDDLQQRIEKLEALTKIT

SEQ ID NO: 245 - protein, 66 aa, Pelodictyon phaeoclathratiforme
MQDEFYSKNKEITILDVLDRVLTKGVVITGDIVISVADIDLVYVGLRLLLSSVETMEKNKQNSIKM

SEQ ID NO: 246 - protein, 101 aa, Phormidium tenue NIES-30
MATATQGSSLVDVIERVLDKGIVIAGDISVSVGSTELLSIRIRLIISSVDKAREIGINWWESDPYLSSRTNELLEANQQLQSRLETLEAELKALRSAEPVS

SEQ ID NO: 247 - protein, 125 aa, Planktothrix agardhii str. 7805
MNSQQLPSNIQRGVPTSTQGSSLADILERVLDKGIVIAGDISVSVGSTELLNIRIRLLIASVDKAREIGINWWESDPYLSSQTKVLTESNQQLLEQVKFLQEEVKALKALLPQENQPNPISDPHK

SEQ ID NO: 248 - protein, 121 aa, Planktothrix rubescens
MNSQQRPSNIQRGVPTSTQGSSLADILERVLDKGIVIAGDISVSVGSTELLNIRIRLLIASVDKAREIGINWWESDPYLSSQTKVLTESNQELLEQVKLLQEEVKALKALLPQENQPKEME

SEQ ID NO: 249 - protein, 72 aa, Psychromonas ingrahamii 37; identical to SEQ ID NO: 94

SEQ ID NO: 250 - protein, 74 aa, Psychromonas ingrahamii 37
MPMANVSINPELTAQECEKISLCDALDRIINKGVVIHGEITISVANVDLISLGVRLILSNVETREQSNTPKEEV

SEQ ID NO: 251 - protein, 101 aa, Psychromonas ingrahamii 37
MATGKPQSMTHSVKSTTVADLLERILDKGIVVTGDIKIKLVDVELLTVELRLVICSVDKAVEMGMDWWNNNPAFAPQAPAQEGELSSIEKRLEKIEKALVK

SEQ ID NO: 252 - protein, 151 aa, Rhodobacter capsulatus SB 1003
MGYRSASQPEGLADVLERILDKGIVIAGDVSVSLVGIELLTIRLRLLIATVDKAREMGIDWWSHDPYLNGRLRPGEPAPETETETAALRDRLAQLEAQLSALGAQVGAAPALAEPALRGLAAAGSSALCAAPEASSADVVQPVFRRYKEAP

SEQ ID NO: 253 - protein, 69 aa, Rhodobacter capsulatus SB 1003
MDDRFSLRLFGPEEVFDAPSGGLADLLDGLLGHGIVLHGDLWLTVADVELVYVGLSAVLASPEALRSHE

SEQ ID NO: 254 - protein, 104 aa, Rhodobacter sphaeroides 2.4.1
MSFQMQSPLQQDSLADVLERILDKGIVIAGDISISLVGIELLTIRLRLLVATVDKAREMGINWWESDPRLCITQAPASDGSAALLDRLERIETQIGQLAAAREG

SEQ ID NO: 255 - protein, 74 aa, Rhodobacter sphaeroides 2.4.1
MTDSAPTLQFATAEEALQSSETRLVDVVDALLSQGIAIRGELWLTIADVDLVFLGLDLLLANPDRLQCRVPDAA

SEQ ID NO: 256 - protein, 137 aa, Rhodococcus hoagie 103S
MTRSGSGANYPQQYSQGLGGAGHEPANLGDILERVLDKGIVIAGDIRVNLLDIELLTIKLRLVIASLETAREVGIDWWEHDPWLSGNNRDLELENERLRARIEALESGERRVADVTDPHRAVQPAESPAAEVRDDDA

SEQ ID NO: 257 - protein, 65 aa, Serratia sp ATCC 39006
MPVNKQYQDEQQQVSLCEALDRVLNKGVVIVADITISVANIDLIYLSLQALVSSVEAKNRLPGRE

SEQ ID NO: 258 - protein, 110 aa, Serratia sp ATCC 39006
MSGNKKLTHSTDSTTVADLLERLLDKGVVISGDIRIRLVEVELLTLEIRLLICSVDKAVEMGLDWWSGNPAFDSRARVSSSAPAPELEERLQRLEARLEAAPSVIEETHL

SEQ ID NO: 259 - protein, 123 aa, Stella vacuolate ATCC-43931
MSGQRMEHSVQAVGLADILERVLDKGIVIAGDISISLVEVELLTIRLRLVVASVDRAMSMGINWWQSDPNLNSHARQLEEDNRLLRERLDRLEAALALPEMAGERLADAGQGGGAEQGVTHGR

SEQ ID NO: 260 - protein, 78 aa, Stella vacuolate ATCC-43931
MSDPEPIIPRTSGDIALADLLDRALHKGLVLWGEATISVAGVDLVYLGLKVLVASTETADRMRAAAASQSADPKVRAG

SEQ ID NO: 261 - protein, 71 aa, Thiocapsa rosea strain DSM 235
MMLAIGEHPDCPEEIQRVSLCEALDRILNKGAVVSGELTIAVANVDLLYLSLQLVITSVETAKREMLYVRH

SEQ ID NO: 262 - protein, 116 aa, Thiocapsa rosea strain DSM 235
MSVQRSTLTHSTNSTSVADLLERVLDKGIVIAGDIRIKLVDIELLTIQLRLVICSVDKAREMGIDWWSDNAMFKGLSSQASAASLPGTAAASGIEDRLARLESLLVKQSAAAETVL

SEQ ID NO: 263 - protein, 121 aa, Tolypothrix sp PCC 7601
MADILERVLDKGIVIAGDISVSIASTELLHIRIRLLISSVDKAKELGINWWENDPYLSSKSQRLVEENQQLQQRLESLEAQLRSLTAAKINNPELFPVNAEDNGQSDEENVPLPMNYQPND

SEQ ID NO: 264 - protein, 54 aa, Trichodesmium erythraeum IMS101
MFIRVDFLLDKGVIVDAWVRLSLVVIELLTIEAKIVIASVEAYLKYSEAFCFNY

SEQ ID NO: 265 - protein, 75 aa, Trichodesmium erythraeum IMS101; identical to SEQ ID NO: 58

SEQ ID NO: 266 - protein, 72 aa, Trichodesmium erythraeum IMS101; identical to SEQ ID NO: 59

SEQ ID NO: 267 - protein, 103 aa, Trichodesmium erythraeum IMS101
MKTSANIATSASGNGLADVLERVLDKGVVIAGDISVSIASTELLNIKIRLLISSVERAKEIGINWWESDPYFSSQNNSLVQANEKLLERVASLESEIKALRSN

SEQ ID NO: 268 - protein, 104 aa, Trichodesmium erythraeum MS101
MKTSANIAKSAGGDSLADVLERVLDKGIVIAGDISVSIASTELLNIKIRLLISSVERAKEIGINWWESDPSLSSQNNSLVQVNQKLLERVASLESEIEALKYSQ

SEQ ID NO: 269 - protein, 155 aa, Anabaena-flos-aquae
MVCTPAENFNNSLTIASKPKNEAGLAPLLLTVLELVRQLMEAQVIRRMEEDLLSEPDLERAADSLQKLEEQILHLCEMFEVDPADLNINLGEIGTLLPSSGSYYPGQPSSRPSVLELLDRLLNTGIVVDGEIDLGIAQIDLIHAKLRLVLTSKPI

SEQ ID NO: 270 - protein, 94 aa, Bacillus-megaterium
MQPVSQANGRIHLDPDQAEQGLAQLVMTVIELLRQIVERHAMRRVEGGTLTDEQIENLGIALMNLEEKMDELKEVFGLDAEDLNIDLGPLGSLL

SEQ ID NO: 271 - protein, 101 aa, Ancylobacter aquaticus strain UV5
MTAPCTAETLENALRGRIDIDPEKVEQGLVKLVLMLVETVRQVVERQAIRRVEGGTLTEEETERLGLALMRLEEKMAELRLHFGLEDGDLDLKLQLPLGEL

SEQ ID NO: 272 - protein, 169 aa, Aphanizomenon flos-aquae NIES-81
MVYSPVENSNDFLNVIPVENSNEFLNTSPKKKSNSETGLAPLLLTVLELIRQLMEAQIIRRMEEDLLSESDLERTAESLQKLEEQILNLCQIFDIDPADLNINLGDFGSLLPASGSYYPGETGNRPSILELLDRLLNTGIVVDGEIDIGVAQLDLIHAKLRLVLTSKPI

SEQ ID NO: 273 - protein, 157 aa, Aphanothece halophytica strain PCC 7418
MSADESNLSQVNLNPATSNSDAGLAPLLLTVTELIRQLMEAQVIRRMDGGLLNEEELDRAGDSLQRLEAEIIRLCEIFEIDPKDLNVDLGELGTLMPKNGGYYPGESSDDPSILELLDRILHKGVVIDGNLDLGIAQLSLIQARLHLVLTSQPINGK

SEQ ID NO: 274 - protein, 105 aa, Aquabacter spiritensis strain DSM 9035
MTGFAGGPAVTETLESVLQGRVDIDPERVEQGLVKLVLMVVETLRQVIERQAIRRVEAGALTDEEIERLGLTLLRLEEKMAELRVQFNLSEADLSLKLRLPLGEL

SEQ ID NO: 275 - protein, 119 aa, Bradyrhizobium oligotrophicum S58
MSASSHSEAPGLRLQLGDLDTALAAVFTDAAPNGSINLDPDKIEHDLARLVLTLIEFLRRLLELQAIRRMEANELSEDEEERVGLALMRAAAQVSRLARELGVDPRELNLQLGPLGRLL

SEQ ID NO: 276 - protein, 120 aa, Burkholderia thailandensis sp. Bp5365 strain MSMB43
MNAPHAAAVSDAAALAAALEQALAQQQAPPPRATQRFDVATASAGNGLAKLVLALMKLLHELLERQALRRIEAGSLNDDEIERLGLALMRQAEEIERLAAQFGFTDADLNLDLGPLGRLF

SEQ ID NO: 277 - protein, 114 aa, Chlorobium luteolum DSM 273
MHEDKVQFQASSVEEALRQLEGMKQGKESRIEANPDNVESGLARLVLTLIELLRKLMEKQAMRRIDGGSLDEAQIDELGETLMKLEMKMDELKKTFNLTDSDLNLNLGPLGDLM

SEQ ID NO: 278 - protein, 156 aa, Dactylococcopsis salina PCC 8305
MSEEESNLSRVDLNPASSNSDAGLAPLLLTVTELIRQLMEAQVIRRMDAELLTEAELDRAGESLQRLEEEILRLCEIFDVDPADLNVHLGELGTLLPKEGGYYPGETSDQPSILELLDRVLHTGVVIDGNLDLGIAQLNLIQAKLHLVLTSQPINN

SEQ ID NO: 279 - protein, 128 aa, Desulfobacterium vacuolatum DSM 3385
MIKDPEAKDFKIESDSIDAFARVMHADTSSCSSSSVTAGQRQQRLKIDEENIKNGLAQLVMTLIKLLHELLERQAIRRIESGSLDDDQIERLGLTLMQQCEEIDRLRKLFDLEEEDLNLDLGPLGKLL

SEQ ID NO: 280 - protein, 121 aa, Desulfomonile tiedjei DSM 6799
MNPMNIAKVESDSLGDFAEIMQTDWISSLHSDKEEKRLNLNQDSVKNGLGQLVLTLVKLLHDLLERQAIRRMEAGTLTDTEIDRLGTTLMMQAQEIERLRSEFGLEEEDLNLDLGPLGKLL

SEQ ID NO: 281 - protein, 104 aa, Desulfotomaculum acetoxidans DSM 771
MYIDISEGSLKQGVLGLLLALVEIIKDALKIQALKRIEGDSLTEDEIERLGNALHELEEALVEIEMEHNLQNVVQNIREGLDNVVNEVVDTFNPERWIAENEFN

SEQ ID NO: 282 - protein, 155 aa, Dolichospermum circinale
MLSTPADNFDESLTTVSKSKNEAGLAPLLLTVLELLRQLMEAQVIRRMEDNLLSESELERAADSIQKLEEQILHLCETFEVDPAELNINLGDFGTLLPQSGSYYPGETGSRPSVLELLDRLLNTGVVLDGEIDLGLAQLDLIHAKLRLVLTSKPI

SEQ ID NO: 283 - protein, 94 aa, Enhydrobacter aerosaccus strain ATCC 27094
MTKLLEAKTVDPDKAGDDLVKLVLALVETLRQLVERQAIRRVDSGVLNDDEVERLGLALLRLEEKMSELKAHFGFGDEELTLKLGSLGELARDV

SEQ ID NO: 284 - protein, 146 aa, Isosphaera pallida ATCC-43644
MSDSLFEVRSPSAAPPSPVNPGVADEWTAVLKDWDTLTAQLRQATAPPNAENSARSHATTGRIDLDPEQVGDGLAKLVLTLLELIRQLLERQAIRRLDAGSLDHEQTERLGLTLMRLAQRMEELKTHFGLQGEDLNLDLGPLGKLL

SEQ ID NO: 285 - protein, 98 aa, Legionella drancourtii LLAP12
MNDKREEDNALPQRINLQPDDVKNGLGKLVLILIQLIHELLERQAIGRIEAGDLSDEQIDRLGITLMKQAEEIDKLREVFGLTQEDLNLDLGPLGKLL

SEQ ID NO: 286 - protein, 157 aa, Microcystis aeruginosa NIES-843
MTLACTPYDSDNQALLTRPESNSQAGLAPLLLTVVELVRQLLEAQIIRRMEKGVLSESDLDRAAESIQKLQEQILYLCEIFEVEPEELNVHLGEFGTLLPEAGSYYPGEEGIKPSVLELVDRLLNTGVVVEGNVDLGLAQLDLIHLKLRLVLTSQPV

SEQ ID NO: 287 - protein, 144 aa, Nostoc punctiforme ATCC 29133
MQAISKSKGSDSGLAPLLLTVVELIRQLMEAQVIRRMDAGTLNDSELDRAAESLQKLEQQVVQLCEIFDIDPADLNINLGEMGNLLPQSGGYYPGETSSQPSILELLDRLLNTGVVVEGDLDLGLAQLSLVHAKLRLVLTSKPL

SEQ ID NO: 288 - protein, 155 aa, Nostoc sp PCC 7120
MVCTPVEKSPNLLPTTSKANSKAGLAPLLLTVVELIRQLMEAQVIRRMEQDCLSESELEQASESLQKLEEQVLNLCHIFEIEPADLNINLGDVGTLLPSPGSYYPGEIGNKPSVLELLDRLLNTGIVVDGEIDLGLAQLNLIHAKLRLVLTSRPL

SEQ ID NO: 289 - protein, 132 aa, Octadecabacter antarcticus 307
MKTTSDSQFDSMKKILTDSSKEDSASCDPTDLLPNKSLPPSLSTSPETAADDLVKLVLAVIDTVRQVMEKQAIRRVESGALAEAEIERLGLTLMRLEARMVELKSHFGLSNEDLNLHFGTVQDLKDILNDEE

SEQ ID NO: 290 - protein, 132 aa, Octadecabacter arcticus 238
MKTQNDTQFDSMKKILTDSGGGDPNPNGSPDQTQHASLPSNLSTDPETAADDLVKLVLAVIDTVRQVMERQAIRRVDSGALADEEIERLGLTLMRLEERMADLKSHFGLSNEDLNLNFGTVQDLKDILNDEE

SEQ ID NO: 291 - protein, 114 aa, Pelodictyon phaeoclathratiforme
MDSDKILYYAGSADEIIEELEKLKPGIQGRINATPDNVESGLAKLVLTLIELIRKLIEKQAMRRIDGNSLSESQIEELGETLMKLEKKMEELKGIFNLTDKDLNLNLGPLGDLM

SEQ ID NO: 292 - protein, 156 aa, Phormidium tenue NIES-30
MTSENAEPDLSTTLALQPPAKTDAGLAPLLLTVIELVRQLMEAQVIRRMESGDLDDNDLERAADSLRKLEEQVVSMCEIFDVDPADLNIDLGEIGTLLPKEGNYYPGQKNQNPTILELLDRLLDTGVVVEGDVDLGMAQLNLIHAKLRLVLTSKPI

SEQ ID NO: 293 - protein, 153 aa, Planktothrix agardhii str. 7805
MSSSEPSIETIITPKSSRKDAGLAPLVLTLVELIRQLMEAQVIRRMEGNTLSEEELDRAAQSLQQLEIQVLKLCEIFEIDPTDLNIELSEFGTLLPKSGSYYPGENTQNPSILELLDRLMNTGIVVEGSVDLGLAQLNLIHAKLRLVLTSKPL

SEQ ID NO: 294 - protein, 110 aa, Psychromonas ingrahamii 37
MPFEHFKSNNQADVNSDTKPAASVGGLNLESDDLKNGLGRLVLTLVKLLHELLERQALRRMDAGSLQDDEIERLGLAFMKQAEEIDRLRKEFGLEVEDLNLDLGPLGRLL

SEQ ID NO: 295 - protein, 112 aa, Rhodobacter capsulatus SB 1003
MSAAMHLELGDVDAVLSQAARSLAAGGRLTLDPERVEQDLARLVLGIVELLRKLMELQAIRRMEAGSLTPEQEETLGLTLMRAEAALHEVAAKFGLQPADLILDLGPLGRSV

SEQ ID NO: 296 - protein, 110 aa, Rhodobacter sphaeroides 2.4.1
MTYPFPPLLLRDDRLPPTEAPVTAPRIALDPDRLEHDLARILLGLMEMLRQIMELQAIRRMEAGSLSESQQEQLGTTLMRAEAAIHEMAARFGLTPADLSLDLGPLGRTI

SEQ ID NO: 297 - protein, 91 aa, Rhodococcus hoagie 103S
MRRRIDSDPESVERGLVALVLTLVELLRQLMERQALRRVDAGDLSDDQIERIGTTLMLLEEKMEELREHFGLEPEDLNIDLGPLGPLLAED

SEQ ID NO: 298 - protein, 115 aa, Serratia sp. ATCC 39006
MTTNQLSHHSPVFGPTSPAIQRPITEANRHKIDIDGERVRDGLAQLVLTLVKLLHELLERQAIRRMDSGSLSDEEVERLGLALMRQAEELTHLCDVFGFKDDDLNLDLGPLGRLL

SEQ ID NO: 299 - protein, 105 aa, Stella vacuolate ATCC-43931
MTGFLNGPADVETLETALRGRVDIDPERVEQGLVKLVLMVVETLRQVIERQAIRRVESGSLTDDEVERLGLTLMRLEEKMDQLRRQFDLGEEDLSMRLRLPLQEL

SEQ ID NO: 300 - protein, 127 aa, Thiocapsa rosea strain DSM 235
MSDTRTGTAPSSAASAAPDTSTLQRANLLADLLETKVAAAGRRIDIDPERVQRGLGQLVLTVVKLLHVLLERQAIRRVDGGDLDEDEIEQLGLALMRQSEEIERLRRLLGLEEQDLNLDLGPLGKLF

SEQ ID NO: 301 - protein, 160 aa, Tolypothrix sp. PCC 7601
MAMVCTPSENSNDLLATNSKANNQAGLVPLLLTVVELIRQLMEAQVIRRMEEECLSESDLERAAESLQKLEEQVLNLCQIFEIDPADLNIHLGELGSLLPAAGSYYPGETGNTPSVLELLDRLLNTGVVVDGELDLGVAQLNLIHAKLRLVLTSKPLNTK

SEQ ID NO: 302 - protein, 153 aa, Trichodesmium erythraeum IMS101
MSLENSPEESLIVPIDKSKSNPEAGLAPLLLTVIELLRELMQAQVIRRMDAGILSDEQLERAAEGLRQLEEQVIKLCKVFDIPTEDLNLDLGEIGTLLPKSGEYYPGEKSENPSVLELLDRILNTGVVLDGTVDLGLAELDLIHARLRLVLTA

SEQ ID NO: 303 - protein, 231 aa, Ancylobacter aquaticus strain UV5
MLYLYAILESPPPQKPLPPGIGGAAPLFVESHALVCAASEAADAAIAREPSQIWRHQEVVAALMEGRPVLPLRFGTVVEDSAACLRLLARHHAELSAQLDRVRHCVEFALRVAGLSELADPGLDPNATPAGLGPGASHLRTLVRRERGWPVSSAAFPHDTLTAHAASRLLWARSPSQPDLRASFLVQRRSASAFLDDVNALQRLRPDLGITVTGPWPPYSFSDPDLSGGRE

SEQ ID NO: 304 - protein, 223 aa, Aphanothece halophytica strain PCC 7418
MLYTYCFLFSPEKTLSLPQGFKGDLQMIEKGAIAAVVEPNLPKAELEEDDQKLVQAVVHHDWVICELFRGLTVLPLRFGTYFRGEADLRSHLAAYEESYQQKLTALTGKVEVTLKLTPIPFSEEGSSSTAKGKAYLQAKKQRYQQQSNYQTQQQEALEKLQEEIKKTYPQLIHDEPKENTERFYLLIDSHSFSVFGEKMEQWKQFLSSWSIEISDPLPPYHFL

SEQ ID NO: 305 - protein, 226 aa, Aquabacter spiritensis strain DSM 9035
MLYLYAVLEAPPPARSLPPGIGGGAPHFIEAFELVCAASETPNRSVAPEPAEVWRHQQVVEALIDRAPALPLRFGTLVEDASACRRLLTRHRDALGAQLGRVRHCVEFALRVSGLPEEVAPDPGIGGGPGTSYLRTLARREAGWPPSTAVFPHDGLAAHAAERLLWARSTSQPDLRASFLVRKPNVAAFLADVSALQRVRPDLGITCTGPWPPYSFSDPDLSGVSP

SEQ ID NO: 306 - protein, 269 aa, Bacillus-megaterium
MGELLYLYGLIPTKEAAAIEPFPSYKGFDGEHSLYPIAFDQVTAVVSKLDADTYSEKVIQEKMEQDMSWLQEKAFHHHETVAALYEEFTIIPLKFCTIYKGEESLQAAIEINKEKIENSLTLLQGNEEWNVKIYCDDTELKKGISETNESVKAKKQEISHLSPGRQFFEKKKIDQLIEKELELHKNKVCEEIHDKLKELSLYDSVKKNWSKDVTGAAEQMAWNSVFLLPSLQITKFVNEIEELQQRLENKGWKFEVTGPWPPYHFSSFA

SEQ ID NO: 307 - protein, 266 aa, Burkholderia thailandensis sp. Bp5365 strain MSMB43
MNDALYLFCFARAEPLAPAWAKRAPGEPRLQLLHEGNLAAVLCDVSRSEFAGADAERRLADPAWIAGRVAVHAAAIEWTMRYSPVIPAQFGTLFSGAGRVIALMESCHAHIGRVLDHVEGKTEWAVKGWLDRQAAADSQAALLRADEPESAARTAGARYLRERQLQARAGQNLRDWLEQSVPPISARLQRHAVEMCSRPCRASDSEHEIVANWAFLVRNRDVPAFRRQAEAIDAEFATWGLHFDFSGPWPPYSFCAPLTEETTWSG

SEQ ID NO: 308 - protein, 292 aa, Chlorobium luteolum DSM 273
MPCRLTVTWKSLRTAGLLPTAKGIQGRTERMAQNILYVYCIVRQLPGADIVARYPDLVFIEAGSAYVAAKYVSPLEYSDASMKLKLADEEWLDRNAREHLSVNVMIMAQQTIIPFNFGTIFKSRESLSGFLGDYGRKLDESFDALEGREEWAVKAYCNESFLLKNLHLESPAIAAIEQEIQAASPGKAYLLKKKKEAMSASALEGVHQGHAKAVWGELAALSKEHVLNRLIPEDVSGVDGRMIVNGVFLIANTDVGAFIRTTEDLGERYRDAGVFLDVTGPWPPYDFVDIPY

SEQ ID NO: 309 - protein, 225 aa, Dactylococcopsis salina PCC 8305
MLYTYCLIASSPSALSLPSGFRGELQLIKQGAIAAIVEAELPLEELEENDQKLIQAVIHHDAVICEIFQQIPLLPLRFGTYFPTEKDLLEHLDFKAEKYQKKLQEIQDKVELTLKLTPLPFSTENASPMEKQGKNYLKAKKQRYQEQTNYQSQQQAELNQLQTQINQDYPQFIHGEPKENIERFYLLIKERDRSVFSEQLEQWKKDFPTWTIEVSDPLPPYHFIE

SEQ ID NO: 310 - protein, 269 aa, Desulfobacterium vacuolatum DSM 3385
MEKKKAVYLYCVTRANKFNAPGITGIDANTPVCFEHLENFVAVYNIIPLNTFVGTSAEENMKNIDWIGPRAMRHENVIERMMQESSVYPARFATLFSSMENLRETLHLKSGLISRFLNQTQHKCEYSLKGFINRKQLLEFLIKTKFKQEKKQLDGLSPGKKYFAQHQFNKKVETGINQWIKRRCGIFLDHLTKRNPEVSPRELFTEKTEKNNLEMMFNLAFLIHNDSKSAFLQEISQAEKEFSQTGISLVVSGPWAPYSFCKTTRGEGL

SEQ ID NO: 311 - protein, 268 aa, Desulfomonile tiedjei DSM 6799
MSNVLYLFCLARTGLVDHIEGTGITGTEDLILKNFSGVTAVTCEVPEDDFSGESAEIKLQDLAWVGPRAVRHDRIIEEIMQYSPVFPAPFGSLFSSEKRLGTLIESNIDAIREFLDHTADKQEWSVKGLVCKSKAVDEIFTGKLKILSETLSSSPAGMRYFKERQMRSEAEKELSGKVKAACTVVGEKLLACSNNFRQRKNISFGKAEGDKQLVVNWAFLVDHSRISYFLDQVEHANSNYQAGGLAFECSGPWPPYSFCPSLHMEPTR

SEQ ID NO: 312 - protein, 259 aa, Desulfotomaculum acetoxidans DSM 771
MNLIDDCKAKYIYCIGENPGNWPSEVMGVEGSLVYHVVYRDIAAVVHDCAEQPYNSDDNNKVIDWVLGHQLVVDKACSCYSSVLPFTFNSIVKGKEDLSSHEILVNWLEDNYDNFKLKLGKIKGKKEYSVQLFLDKQVSLSLLQSESDILELQVELLGSAKGKAYFVQEKINKKIGELMANRADSYCRQFYHEISSVVSECKLCKLKQAGRNEIMIINLVCLAGDNEVEVLGDVLEKIKSNDIAIKIKFSGPWPAYSFV

SEQ ID NO: 313 - protein, 240 aa, Enhydrobacter aerosaccus strain ATCC 27094
MLYVYGIADNAFEVLRGAGLLNSDVFAVPAGCLAAAASKLAQGGIETTPQGVWRHEQVLRQLMQDHAVLPLRFGTICRDRETLTDRLMEASDDLVRGLGRVRGKVEIALRIVDEREHEAHPVPSETPTVDAIGGGRGTAYLRARRRHHAAEMGREARAERVGKMLSAYIDVGAEDLVCSVAPEGDHAVSVSCLLGRDQLATLQAALERFQSDHPAIGLSWTGPWTPYSFVAPSLFGVGLP

SEQ ID NO: 314 - protein, 266 aa, Legionella drancourtii LLAP12
MNKALYLFCLTPASDLPMMEGELLPNFSPLFIHPFQTFNAILSWVPAKEYQEQSTDSNLINTEEFMQRVFFHELVVEKIMRDEAVFPIGFGTLFSSIASLEEQILTHQTLISSCLANLNQKDEYAVRVYLNQDKALESLLSVMLQERESSWASSSPGVQYLKKQQLHNEIQRNLNQHLGGMLDEVLSMFQRHATDFKSRENTAQSSDIHGTSILHWAFLIPRVVSSIFKEQVDLMNAKYNPFGLHFVLTGPWPAYSFCTLQSVEAP

SEQ ID NO: 315 - protein, 240 aa, Lyngbya confervoides BDU141951
MRWHRSEAVISYCDLSMIYLYALCPNSTETNNLPEGIGTAQVEVLTVGTLGAVIERDVDIAQIQKDDAQLMAAVLAHDRILSHLFTYSPLLPLRFGTQFSNSEAVTTFLKTQGETYRQKLSHLQDRAEYLVKLIPQPLDLPAIASDLKGREYFLAKKQRLQDHTAALNQQADELQTFLTDLATQDIPLVRSAPQDHEERLHVLLSRDTDTTEQVIMTWQEQLPNWQVVCSEPLPPYHFAA

SEQ ID NO: 316 - protein, 240 aa, Octadecabacter antarcticus 307
MKRLYVYGIVGATSFDDPLPNGHDEASVFALVSGDIAVAVSFVERSAVEASAANVWLHDNVLSALMTRYAVLPMRFGTIAVGATQLLEGIVKRQKQLMKDLMRLNENVEIALHISGKNWEKVNQKVTKKNTDQAITQGTAYLLGRQQSLYGSDKTQLLVQNVRRAIRSGLDPLMKDVIWPIDKPQALPFKASCLINRNDVASFVQIVNDIAAQNLDARVTCTGPWAPYSFVGKSGVEGET

SEQ ID NO: 317 - protein, 240 aa, Octadecabacter arcticus 238
MTKLYVYGIVGATHFDVKLPNGHDEAPVFAIVSGDLAVAVSSLERSAVEASAANVWLHENVLSALMEGHAVLPMRFGTIATGAAQLLGDIVKRRGQLMKDLTRLDGKVEIALRISGKNREKVEQRIAGQIVDTNVTQGVAYLQEKQQNLYGSFYTQSSVQCARRAIRSQLDPFIVEAIWPTDEPQMLPFRASCLIKKGDIARFVQTVDDVVVKVSDIRVTCTGPWAPYSFVGQSGSEAET

SEQ ID NO: 318 - protein, 266 aa, Pelodictyon phaeoclathratiforme
MVAIQERLIYIFCVTSEPPLLQQYQLQKGICVVDVDGLFVTTMDVTDNDFAENQLQSNLSDVVWLDTKVREHLDVITSIMQHVKSLIPFNFGTLYKSESSLMQFIIKYAEEFKKNLVYLEEKEEWAVKLYCNKNKIVENITHLSKKVSDINALIQNSSIGKAYILGKKKNEIIENEIINIYNTYSKKIFTKFSILSEEFRFNPIPNNETLEKEDDMILNVVLLLNKANVESFIETSDQLIIQHQNIGLNIEITGPWPCYSFINISH

SEQ ID NO: 319 - protein, 249 aa, Pelodictyon phaeoclathratiforme
MPLIIYAIFDSINYIDSFSSYVDAISLKSKIKLEIISTSTLSAIVSRTTDEKKQACQNDVMIYATIIGDIAAKYSILPMRYGSIVSSPFDVTELLKNHNETFVTIIKKITDKEEYSLRILYSHQDKEKNNIEDLFDLPQNVPDILHGNTDSKKYLLNKYIKHLSEEKRLQYIDKIQSIVACNLQKITDLIVYNKQTTTGFIVDAVFMIERSKKSELLDLVIQMQTLFSEHNVVLSGPWPPYNFSNINIG

SEQ ID NO: 320 - protein, 270 aa, Psychromonas ingrahamii 37
MKNSNHSGLDPNQALYLYCFVHADSIQSVTSQAIEKDSPVFIYQWQDIAAVLSHVPTSYFTGYDDEEPEQTIARILPRTQLHEQVIEEVMRQSPVFPAQFGTLFSSQESLEQEISQQYLAITHTLKEVSGSVEWAVKGVLDRGVAEKALYSQQLTEQQNSLSSSPGMRHLQEQRLRRETQSKLNSWLHQLYTDIATPLSELSGDFFQRKIPSSIEEGKEVILNWAFLVPESAGDDFHAQIDKLNQRLNSFGLVIQCSGPWPPYSFCNQSS

SEQ ID NO: 321 - protein, 270 aa, Psychromonas ingrahamii 37; identical to SEQ ID NO: 320

SEQ ID NO: 322 - protein, 262 aa, Serratia sp ATCC 39006
MTMNTEAQTEQAIYLYGLTLPDLAAPPILGVDNQHPINTHQCAGLNAVISPVALSDFTGEKGEDNVQNVTWLTPRICRHAQIIDSLMAQGPVYPLPFGTLFSSQNALEQEMKSRATDVFVSLRRITGCQEWALEATLDRKQAVDVLFTEGLDSGRFCLPEAIGRRHLEEQKLRRRLTTELSDWLAHALTAMQNELHPLVRDFRSRRLLDDKILHWAYLLPVEDVAAFQQQVADIVERYEAYGFSFRVTGPWAAYSFCQPDES

SEQ ID NO: 323 - protein, 226 aa, Stella vacuolate ATCC-43931
MLYLYAVLEALPAARTLPAGIGGGELLFVEAFELVCAASETPERAIAPEPTQVWRHQQVVEALIDCAAALPLRFGTLVEDAVACRRLLTRHREALCAQLDRVRHCVEFALRVSGLREEVGSDHVIGGGPGVSYMRALARREASWPPSTGTFPHDGLAAHAADRLLWSRSASQPDLRASFLVLKPNVAAFLADVSALQRMRPDLGITCTGPWPPYSFSDPDLSGMSP

SEQ ID NO: 324 - protein, 250 aa, Thiocapsa rosea strain DSM 235
MDAFYCFCFAPACLASDLRFDDCGWEDPIEIRRLAGLDVILSRVPLGRFAGAEAEQRLADLEWLVPRAQAHDRVITRTMERSTVFPLTFATLFSSLPALALEVAARRRALLDFFERMAGREEWAVKVSMDRERVIATRMQSLYPEGGDVPAGGRGYLLKQRRRGEAEQAIGPWLKGQIGCLDEALRPSCETLLIRPLRDEMVASRACLVARDLGPSLSEAIERSREAFADQGLDLHCSGPWPLYSFCGTP

SEQ ID NO: 325 - protein, 225 aa, Trichodesmium erythraeum IMS101
MSYYVYGFLYLPESCLALPKGMEKEVELVPYQNIAAVVEANVSIEAIQETEEKLLEAILAHDRVVREIFQQVSMLPLRFGNAFALRENIINDLQNNQQQYLNILTKLQQQAEYTITFTPVSYPSTLEVSKVRGKAYLLAKKQQFEQQQAFQTKQRQQWENIRQLIFKNYPKAVFRDSTESKIKQVHLLANRDARVITTEELSTWQTECSYWQITLSEQLPPYHFV

SEQ ID NO: 326 - protein, 335 aa, Anabaena flos-aquae
MTTTKVNHKRAVLRLRPGQFVVTPAIERVAIRALRYLKSGFPVHLRGPAGTGKTTLAMHLANCLDRPVMLLFGDDQFKSSDLIGSESGYTHKKVLDNYIHSVVKLEDEFKQNWVDSRLTLACREGFTLVYDEFNRSRPEVNNVLLSALEEKILSLPPSSNQPEYLSVNPQFRVIFTSNPEEYAGVHSTQDALMDRLVTISMPEPDEITQTEILIQKTNIDRESANFIVRLVKSFRLATGAEKTSGLRSCLMIAKVCADNNIPVTTESLDFPDIAIDILFNRSHLSMSESTNIFLELLDKFSAEELEILNNRVTGDNDFLIDNSQFVSQQLAGQPN

SEQ ID NO: 327 - protein, 357 aa, Ancylobacter aquaticus strain UV5
MTSEAASKDPISLLSGFGAGAASSGPKAGGRSTPSALTPRPRTGFVEAEQVRDLTRRGLGFLNAGYPLHFRGPAGTGKTTLALHVAAQLGRPVIIITGDNELGTADLVGSQRGYHYRKVVDQFIHNVTKLEETANQHWTDHRLTTACREGFTLVYDEFTRSRPETHNVLLGVFEERMLFLPAQAREECYIKVHPEFRAIFTSNPQEYAGVHASQDALADRLATIDVDYPDRAMELAVASARTGMPEASAARIIDLVRAFRASGDYQQTPTMRAGLMIARVAAQEGFEVSVDDPRFVQLCSDALESRIFSGQRAEEVAREQRRAALHALIDTHCPSAAKPRARRAGGAVRASIEGAQS

SEQ ID NO: 328 - protein, 359 aa, Aphanizomenon flos-aquae NIES-81
MTKTNHKRAVLRVRPGQFVVTPAIEQVAIRALLYLKSGFPIHLRGPAGTGKTTLALHLAHCLDRPVMLLFGDDEFKSSDLIGSESGYTHKKLLDNYIHSVVKVEDEFKQNWVDSRLTLACREGFTLVYDEFNRSRPEVNNVLLSALEEKILSLPPSSNQPEYLSVSPQFRAIFTSNPEEYCGVHSTQDALMDRLVTINMPEPDEITQTEILIQKTNIQKESAHLIVRLVKSFRIATGAEKTSGLRSCLMIAKVCADNNLVAEPENSFFQEIAMEILSNRTHLSVNESTDIFLDVISQFSNKEIEILNDAELGSLPTMDTLANTDLGNDVPLEKEASDYVIQQKNNEFKGFQKPSTKVLN

SEQ ID NO: 329 - protein, 337 aa, Aphanothece halophytica strain PCC 7418
MTTVLHARPKGFVSTPTIDRISRRAWRYLQSGFSIHLRGPAGTGKTTLAMHLADLLNRPIMLLYGDDEFKSTDLIGSNTGYTRKKVVDNYIHSVVKEEDELRQQWVDSRLTMACREGFTLVYDEFNRSPPEVNNVLLSALEEKLLVLPPDSHRSEYVRVSPNFRAIFTSNPEEYWGVHGTQDALLDRVVTINVPEPDLETQREIIVQKVGINADDGDMIVNFVRNFRDRAEMENSSGLRSCLMIAQVCHQHEIPVQTSNEDFQDICYDILTSRCPLSTQESISLLEQLFREYELELVVEDEDEDVPSVIVEGETEDLSSDEKPHLRLSHPFGNTEND

SEQ ID NO: 330 - protein, 364 aa, Aquabacter spiritensis strain DSM 9035
MSTEPAPLVSPSQDVETTPQRPARPEPAEALAVGYRLSARPASPATLTPRPRADFVETDQVKDLTRRGLGFLRAGYPLHFRGPAGTGKTTLALHVAAQLGRPVIVITGDNELGTADLVGSQRGYHYRKVVDQFIHNVTKLEETANQRWTDHRLTTACREGYTLVYDEFTRSRPETHNVLLGVFEEKILFLPAQAREECYIRVHPDFRAIFTSNPQEYAGVHASQDALADRLATIDVDYPDRGMELAVASARTGLGETEAARIIDLVRAFRASGDYQQTPTMRASLMIARVAAQEGLRVSIDDPGFVQLCMDALESRMFSGARLEAATRETSRAALLALLAVHCPSEAPIVRVTAARRAKKADAS

SEQ ID NO: 331 - protein, 394 aa, Arthrospira platensis NIES-39
MTTVLRAVPKGFVNTPAIERITVRALRYLQSGFSVHLRGPAGTGKTTLALHLADLLNRPIMLIFGDDELKSSDMIGNQTGYTRKKVVDNFIHSVVKLEDSLKQNWIDSRLTLACREGFTLVYDEFNRSRPEVNNVLLSALEEKLLVLPPNNSRSEYIRVNPHFRAIFTSNPEEYCGVYSTQDALLDRLITMNMPEPDEATQQEILIQKVAVTPEEAQTIVTLVQQFREATHAIAPSKIQTVARQQTNADKASGLRPSLMLARICQEHNIPIVPIDPDFQEVCRDILLSRAIGDITELESRLHQIFDHLSGLENDQIIALPPREELTTSSVPNNLSDTEQKIYTYIKDSDGARVSEIEIALGLNRVQTTDALRSLLRKSYLTQQDNRLFVVYEGD

SEQ ID NO: 332 - protein, 308 aa, Bacillus-megaterium; identical to SEQ ID NO: 11

SEQ ID NO: 333 - protein, 351 aa, Bradyrhizobium oligotrophicum S58
MLRSDRAAIAGGQRGSRAQGDAVARNDAAAGSRAAIAQISPRPDADNAALSPAPRTDLFENPQLASMAARALTYLNAGIPVHLRGPAGTGKTTMAMQLAARLGRPVVLLTGDDGLTAAHLVGREIGTKSRQVVDRYVHSVRRVETETSSMWCDAVLAQAVVEGLTFVYDEFTRSPPQANNPLLSVVEERILIFPAGSRKERLVHAHPEFRAILTSNPEEYAGVSRPQDALLDRLITFDLDDYDRETEIGIVSNRTGLAYAEAGVIVDLVRGVRRWPKAHHPPSMRSAIMIARIVARELITPSVDDPRFVRLCLDVLAAKAKPTDRDDRDRFAATLLRLMNNHCPAGAIDGG

SEQ ID NO: 334 - protein, 287 aa, Burkholderia thailandensis sp. Bp5365 strain MSMB43
MEASAEFVQTPAVRNLTERALTYLGAGYGVHLAGPSGTGKTTLAFHIAAQLGRQVVLMHGDDELGSADLVGRGAGYRRSRVVDNFIHSVVKTEEEMTTTWIDNRLTTACQHGLTLIYDEFNRSRPEANNALLPVLSEGILNLPNRMTGAGYLTVHPGFRAIFTSNPEEYVGVHKTQNALMGRLITIQVGHYDRETEVEIVRARSGIARADAERIVDLTRRLRDADDNGHHPSIRAAIALARALSYCGGEATPDNAGYVWACRDILGVDLEQDARTRSQAGRRTKARR

SEQ ID NO: 335 - protein, 308 aa, Chlorobium luteolum DSM 273
MRAAVNDNEMNTVLAPRPMANFVETEYIRDITERGLTYLKAGFPVHFRGPSGTGKTTVAMHLAGKIGRPVVVIHGDSEYKTSDLIGSEQGYKFRRLNDNFIHSVHKYEEDMSKQWVNNRLSIAIKKGFTLVYDEFTRSRPEANNILLPILQEKMLSTSASNEEDYYMKVHPEFRAIFTSNPEEYAGVNRTQDALRDRMVTMDLDYFDYETELRVTHAKSELTLEDSEKIVQVVRGLRESGKTEFDPTVRGSIMIARTLHIMQVRPEKTNDAVRKVFQDILTSETSRVGSKTNQEKVRAIVNDLIEAYL

SEQ ID NO: 336 - protein, 273 aa, Dactylococcopsis salina PCC 8305
MTTVLHARPKGFVSTPTIDRISGRAWRYLQSGFSIHLRGPAGTGKTTLAMHLADLLNRPIMLLYGDDEFKSTDLIGSNTGYTRKKVVDNYIHSVVKEEDELRQQWVDSRLTMACREGFTLVYDEFNRSPPEVNNVLLSALEEKLLVLPPDSNRSEYVRVSPNFRAIFTSNPEEYWGVHGTQDALLDRVVTINVPEPDLETQQEIITQKVGINANDGEKIVNFVRQFRDRAAVKNSSGLRSCLMIAQVCHQHEIPVQTSDEGFRDICYDILSSR

SEQ ID NO: 337 - protein, 316 aa, Desulfobacterium vacuolatum DSM 3385
MSASMSSMKETRQRMSAPEQDNVVPEAGSDFVETPYVKDITDRALAYLHVGYPVHFSGPAGTGKTTLAFHVAAKLKRTVMLIHGDDEFGSSDLIGKDSGYRKAKVVDNYIHSVVKTEESMNTVWADNRLTIACQQGCTLVYDEFTRSRPEANNAFLSVLEEKILNIPSLRDIDQGYLQVHPEFRAIFTSNPEEYAGVHKTQDAMMDRLITITLDHFDRDTEVQVTMSKSDLPQKDAEKIVDIVRKLRKTGVNNHRPTIRACIAIGKILKHMGGGASKDNFVFKQICRDVLNVDTTKVTRDGEPLLPRKIDELINSL

SEQ ID NO: 338 - protein, 337 aa, Desulfomonile tiedjei DSM 6799
MNGAELRIASIETEVITANNENIVPEAGDRFVNTPHVEELTARAMAYLEVGYSVHFSGVAGTGKTTLAFHAAAKLGRPVILVHGDHEFGSSDLIGRDAGYKKSRLVDNFIHSVVKTEEEMRSLWVDNRLTTACRDGYTLIYDEFTRSRPEANNVLLSILEEKILNLPSLRRTGEGYLEVHPSFRAIFTSNPEEYAGVHKTQDALMDRIITINVDHYDRETEIEITRAKSGVCKQDATVIVDIIRELRLLGVNNHRPTIRAAIAIARVLAHTGEHADQHNSVFQWLCKDVLSTDTVKVSRGGSPLMAKKVEEVIRKVCGRTGGKRSGKPVGSKEETSE

SEQ ID NO: 339 - protein, 307 aa, Desulfotomaculum acetoxidans DSM 771
MQLNGLDKNSIINPVVLSDFVVTDYISNVVDRALAYIKAGFAIHLRGRSGTGKTSIAMYISSKLNRPTLVIHGDEEFRTSDLIGGRYGYRIRKTIDNFVQSVVKVEEDLVERWVDSRLTTACKNGYTLVYDEFTRSRPEANNILLSVLQERLLDISVARGAEEGYVKVHPDFTAIFTSNPEDYAGVYGSQDALRDRMVTLDLDNYDKETEISIIKSKSKLSREDSERVVNILRDLRELGDCEYGPTIRGGIMIAKTLQVLGAPVDKNNEMFRQICEEVLASETSRAGNLQALRKVRKVINELFNKYA

SEQ ID NO: 340 - protein, 352 aa, Dolichospermum circinale
MSITKVNHKRAVLRLRPGQFVVTPAIERVVIRALRYLRSGFPIHLRGPAGTGKTTLGMHLANCLDRPVMLLFGDDQFKSSDLIGSESGYTHKKLLDNYIHSVVKVEDEFKQNWVDSRLTLACREGFTLVYDEFNRSRPEVNNVLLSALEEKILSLPPSSNQPEYLSVNPQFRVIFTSNPEEYCGVHSTQDALMDRLVTINMPEPDEITQTEILIQKTNIGRESANLIVRLVKSFRLATGAEKTSGLRSCLMIAKICADHDIPASTEDLDFREIAIDILFNRAQLSISESTDIFMGLLEQFSAEEIKVLNDTHFPTDELLINNSQFITQELVTQPNTELATDIPQELRKTEQN

SEQ ID NO: 341 - protein, 321 aa, Enhydrobacter aerosaccus strain ATCC 27094
MSMDQAEEIGVVTTIEPRPRADFVRTQSVEATARRALGYLNAGFSVHFRGPAGTGKTTLALHLAALLGRPMVMITGDEEMLTSTLVGTQHGYHFRRVVDRFIHTVTKTEETADKRWADHRLTTACREGYTLIYDEFTRSRPEANNVLLSVLEEGLLVLPAQNQNEPYIKVHPNFRVIFTSNPQEYAGVHDAQDALGDRIVTIDMGHADRELELAIAAARSGLPPTQVAPIVDMVREFRETGEYDQTPTLRTSIMICRMMSQERLAPTIEDQQFVQICMDILGGKSLPGGKGDNKRAQQQKMLLSLIEHHCPARSFTSVGEV

SEQ ID NO: 342 - protein, 345 aa, Isosphaera pallida ATCC-43644
MDYESTALQLKPRPDFVATPWVRELADRALGYLTAGYPVHFSGPAGTGKTTLAMHLAALVNRPVVLLHGDDEFGSSDLVGDHLGFRSTKVVDNFIHSVVKTEQSVSKTWVDHRLTTACRHGFTLIYDEFNRSRPEANNILLTILEERLLELPPIAGGRDGSGPLRVHPEFRAIFTSNPEEYAGVHKTQDALLDRMITISMGGHDEATETEITAAKSGLSRDEAARIVELARAVRALKPLRHPPTIRSCLMIAKVAALRKVPIDPNDALFLAICRDVLRIDALPVDDPEATFAELIRRVFAPTPAVAPPRVPTTGFAANRVVPIPRRPLAASASPPPGANGHAHLR

SEQ ID NO: 343 - protein, 335 aa, Legionella drancourtii LLAP12
MMTQENNGSLTDSKNNDKLIRFVNNRSDNILLEASEEFTETPHIRGISERALAYLDIGYPIHLLGPAGTGKTTVALHIAAQLGRPVILIHGDDEFTGADLVGRGTGYHHSKLVDNFIHSVLKTEEEMTTMWTDNRLTTACEQGYTLIYDEFNRSRAEANNALLSVLSEGILNLPGRRERDGIGYVDVHSNFRAIFTSNSEEYVGIHKTQNALADRLIAIKMDYPDQQSEIQIIEKKSTLPRKDIEIIVNLARELRLKSEKRPSIRGCIAIARVLAYHNRHAHADDPIFQAVCQDIFGISKEFLKQLLHPMDSGLQKRSEKNQESIKKYKTKNQKL

SEQ ID NO: 344 - protein, 421 aa, Lyngbya confervoides BDU141951
MSTVLQARPRNFVSTPAVERIARRALRYLQSGYSVHLRGPAGTGKTTLALHLADLLSRPIMLVFGDDEFKTSDLIGNQSGYTRKKVVDNYIHSVVKVEDELRHNWVDSRLTLACREGFTLVYDEFNRSRPEVNNVLLSALEEKLLVLPPSGHRPEYLRVNPHFRAIFTSNPEEYAGVHGTQDALLDRLITIHMPEPDELTQQQILIQKVGIEPADALMIVRLVKAFKSQMGNHSATSLRPSLMIANICHEHGVAMMTEDADFRDVCSDVLLSRVTNELSPATHTLWDLFNELTASADVLGPESNSTDVSPQPEADKPVETKGSKGKSTTKSKAKESAKASEEADEAGDDSASAPELDEIESSILTFLTARESASLSEIESELSLTRFKAVDALRSLVEAGYLQKQNGAGKPAIYGLVPEES

SEQ ID NO: 345 - protein, 346 aa, Microcystis aeruginosa NIES-843
MTVTETQTRRAVLSLRPGQFVVTPSIDQIATRALRYLNSGFSIHLCGPAGTGKTTLAMHLANCLARPVMLIFGDDDFTSSDLIGSQSGYTHKKLMDNYIHSVLKVEDELKHNWVDSRLTMACREGFTLVYDEFNRSRPEVNNVLLSALEEKILTLPPTSHQPDYLQVNSQFRAIFTSNPEEYCGVHATQDALMDRLVTINMPEPDQLTQTEILAQKTGIGREDALFIVNLVKTFRVKTATEKTSGLRSCLMIAKVCASHDIAANSADSDFRDICADVLLSRTNLSVDKSRAILWEILEDNPLESLSFLEEEEPSDAQVSTSEPSTGNQSLKAIQSLLRGNLPQRKD

SEQ ID NO: 346 - protein, 390 aa, Nostoc punctiforme ATCC 29133
MTTVLNASPQRFVNTPAVQRIAQRALRYLQSGFSIHLRGAAGVGKTTLAMHLADLLNQPIILLFGDDEFKTSDLIGNQLGYTRKKVVDNFIHSVIKVEDEVRQHWVDARLTLACKEGFTLVYDEFNRSHPEVNNVLLSVLEERLLVLPTNQHRAEYIRVHPQFRAILTSNPQEYCGVHATQDALMDRVITIDMPTPDELSQQEIVVHKTGIDSEKAEVIVRIVRTFWSRSGSGQGGGLRSCLMIAKICHEHEISVNPGDPSFQDICADILLSRTNQPLIEATRLLEEVLSEFYHRINTQSQPSEIIPNNQNQIVLEQRVPYEHEVYNYLCNSPGRRFSELAVELGIDRSQIVAALKSLREQGVLVQMQGNAESPSISQTVAFDSGHLINK

SEQ ID NO: 347 - protein, 410 aa, Nostoc sp PCC 7120
MTLTANNKKRAVLRVRPGQFVVTPAIEQVAIRALRYLTSGFAIHLRGPAGTGKTTLAMHLANCLDRPIMLIFGDDEFKSSDLIGSESGYTHKKLLDNYIHSVLKVEDEFKQNWVDSRLTLACREGFTLVYDEFNRSRPEVNNVLLSALEEKILTLPPSSNQPEYLHVNPQFRAIFTSNPEEYCGVHSTQDALMDRLVTINMPEPDELTQTEILAQKTALNRADALLIVRLVKAFRSRTGGEKTSGLRSCLMIAKVCAEHNILVSPQSSDFREICADVLFNRTNWSASEAATIFLELLNHLDLQQIEEFKNSIIPEDTDAIAEGGFPTIIDSHFGTLDSEVLEQPGVEDSIPFEQEIYLYLQQYKSAALALVQQEFELSRTVATNALNSLEQKGLVSKNNHVYTIEEPNQS

SEQ ID NO: 348 - protein, 342 aa, Octadecabacter antarcticus 307
MNSNLRATNSGGPDISKTMMPEAREDFVQTESVKSISRRALAYINAGYSVHFRGPAGTGKTTMAMHTAALLGRPVVLITGDEEMITSNLVGAESGYNYRKVTDNYIHTVSKIEESSDRSWNDHRLTTACREGYTLIYDEFTRSRAEANNVLLSVLEEGILVLPAQNRGEPFIKVHPNFRVIFTSNPQEYAGVHEAQDALSDRIVTIDIGEADRELEVSIASSRSGLEVAKTEPIVDMVRAFRDTGEYDQTPTLRACIVICRMVANEKLNTTIDDPFFVQICLDVLGSKSTFGGKEHDKRTQQRKLLLDNLKHYCPSKVSTKPSAKDDESKSTLIQVSSRGSL

SEQ ID NO: 349 - protein, 324 aa, Octadecabacter arcticus 238
MMPEARKDFVQTDSVKSVSRRALAYINAGYSVHFRGPAGTGKTTMAMHTAALLGRPVVMITGDEEMVTSNLVGAESGYNYRKVTDNYIHTVSKVEESSDRSWNDHRLTTACREGYTLIYDEFTRSRAEANNVLLSVLEEGILVLPAQNRGEPFIKVHPDFRVIFTSNPQEYAGVHDAQDALSDRIVTIDIGAADRELEVSIASSRSGLEVAKTAPIVDMVRAFRDTGEYDQTPTLRACIMICRMVANEKLNPTIDDSYFVQICLDVLGSKSMFGAKEQGKRTQQEKLLLDNLSHHCPSPPPSKPSAKEAEAKPRSIQATSRGPA

SEQ ID NO: 350 - protein, 308 aa, Pelodictyon phaeoclathratiforme
MRRQGCDSEMNTVLEPKPMPNFVETDYIRDITSRGLTYMKAGFPVHFRGPSGTGKTTVALHLASKIGRPVVIIHGDSEYKTSDLIGSEQGYKYRRLDDNFIHSVHKYEEDMTKQWVNNRLTIAIKKGFTLVYDEFTRSRPEANNILLPILQEKMMSTSSSNEEEYYMKVHPEFRAIFTSNPEEYAGVNRTQDALRDRMVTMDLDYFDYETELMITHAKSGMSLDDAEKIVKIVRGLRESGKTEFDPTIRGSIMIAKTLNVLNARPDKTNELFKKVCQDILTSETSRVGSKTNQERVRGIVNELIDLHS

SEQ ID NO: 351 - protein, 454 aa, Phormidium tenue NIES-30
MNTVLQARPRNFVSTPTLERTSIRALRYLQSGYSIHLKGPAGTGKTTLALHLADLLARPIMLLFGDDEFKTSDLIGNQSGYTRKKVVDNYIHSVVKVEDELRHNWTDSRLTLACREGFTMVYDEFNRSRPEVNNVLLSALEEKLLVLPPSNNRAEYIRVSPHFRAILTSNPEEYCGVHGTQDALQDRLITINMPEPDELAQQQILVQKVGIDSSAALQIVQLVKAFQSAVAPDMVSSLRPSLMIATICHDHDILPLAENADFRDVCSDILLARSKEPAPDATRHLWNLFNRFVVSQAALVNDLSLKPEAHPTARFHGEEEDDAPLQPLEALVESDIDDVAVEDQPVIGPQDLQGETLPEAVIPEPQGETVVETPAEAEALPEEIARVQVSPDDIETRIFDYLDATGTASLVNIEAALDLNRFQAVNAVKSMLDQGLIEKQETDGQLQGYQLSSN

SEQ ID NO: 352 - protein, 398 aa, Planktothrix agardhii str. 7805
MTTVLQARPKGFVNTPTIEQLTIRALRYLQSGFSLHLRGPAGTGKTTLAMHLADLLNRPIVLIFGDDELKSSDLIGNQLGYTRKKVVDNFIHSVVKLEDELRQNWIDSRLTLACKEGFTLVYDEFNRSRPEVNNVLLSALEEKLLVLPPNNSRSEYIRVNPHFRAIFTSNPEEYCGVYGTQDALLDRLITIDMPEPDDETQQEILIQKIGISPEDAKNIIEIVKIYLEITTQKKEIKPVQNGKAARPHIDKASGLRPGLIIAKICHEHDISIQENNQDFIKVCADILLSRTNLSLTEAQNKLEKVIKTVLTDGDTSNNSFLPPSETQLTENNSLEIEEQVYQYLQKTTSARVSEIEVALGLNRVQTTNVLRSLLKQGHLKQQDNRFFAVNKQGELIQP

SEQ ID NO: 353 - protein, 398 aa, Planktothrix rubescens
MTTVLQARPKGFVNTPTIEQLTIRALRYLQSGFSLHLRGPAGTGKTTLAMHLADLLNRPIVLIFGDDELKSSDLIGNQLGYTRKKVIDNFIHSVVKLEDELRQNWIDSRLTLACKEGFTLVYDEFNRSRPEVNNVLLSALEEKLLVLPPNNSRSEYIRVNPHFRAIFTSNPEEYCGVYGTQDALLDRLITIDMPEPDDETQQEILIQKIGISPEDAKNIIEIVKIYLEITTQKKEIKPVQNGKAARPHIDKASGLRPGLIIAKICHEHDISIQENNQDFIKVCADILLSRTNLSLTEAQNKLEKVIKTVLTDGDTSTNSFLPLSETQLTENNSLEIEEQVYQYLQKTTSARVSEIEVALGLNRVQTTNVLRSLLKQGHLKQQDNRFFAVNKQGELIQP

SEQ ID NO: 354 - protein, 334 aa, Psychromonas ingrahamii 37
MSIENLNNVSEIKIEQSDDDHIYPEASEDFVETPYIKEVTERAMLYLDAGYPVHFAGPAGTGKTTLAFHIAALRQRPVTLIHGNHEFGTSDLIGKESGYRRHRVVDNYVHSVVKEEEELQSLWSDNRLTTCCRNGDTLVYDEFNRSTPEANNVLLSILEEGILNLPSSRSDGYLEVHPQFRAIFTSNPQEYAGTHATQDALVDRMITIMLHYPDRHTEVRVAIAKSGINSDEAGSIVDIVNEFRELCGSKIVSSGPKTMPTVRASIAIARVLVQKGEHAFRDNTFFHRICRDVLCMYTQQVSFSNRSVLDKQLEDLIMKFCPATYKSSGSKIRA

SEQ ID NO: 355 - protein, 335 aa, Psychromonas ingrahamii 37
MSINNLNISTIKIEQPENDNIYPEASAEFVQTPYIQEVTERALLYLDAGYPVHFAGPAGTGKTTLAFHIAALRKRPVTLIHGNHEFGSSDLIGKESGYRRHRLVDNYVHSVMKEEEELKSLWVDNRLTTCCRNGDTLVYDEFNRSTPEANNVLLSILEEGILNLPSLRSMGDGYLEVHPSFRAIFTSNPQEYAGTHATQDALVDRMITIMLNYPDRDTEVRVAVAKSGISNEEAGFIVDIVNEFRELSNHKSLSSGQKSMPTVRASIAISRVLIQKGEHAFRDNVFFHRVCHDVLCMYIQKISPSNRSFLDKQLEVLIGKFCPAAKSALVPKVVK

SEQ ID NO: 356 - protein, 305 aa, Rhodobacter capsulatus SB 1003
MTIPRDLPWGDARTPLFEDEELRSLLDRAEIYLREGIAIHFRGPAGVGKTTLALHLAQRFARPVTFFVGNDWLGRADIFGRDLGETVSTVQDHYISSVRRAERKSRIDWQEAPLARAMRDGHVLVYDEFSRSRPEANAALLSVIEEGVLPLSDPAAGRSHIVAHPDFRVILTSNPRDYVGVQAVPDALLDRMITFSLDGMSFETEVGIVATAARTDPADARAICALIHLLRAEKPGTMEISMRSGIMIARLARAAGVAPDPADPVFVQICADVLGTRMRGSDIDDVMALLLRPDPAPAACAGGAR

SEQ ID NO: 357 - protein, 316 aa, Rhodobacter sphaeroides 2.4.1
MTVLSPSLPHAAGIDAALVENPWLGLRRSGRYFQNAETEALFARALGYARAGVCVHLAGPAGLGKTTLALRIAQALGRPVAFMTGNEWLGSRDFIGGEIGQTVTSVVDRYIQSVRRTEQSARIDWKESILGQAMRCGQTFIYDEFTRASPEANAALLSVLEEGVLVSTDGASRHQYIEAHPDFRVLLTSNPHEYQGVKAAPDALIDRMVTLRLEEPSAPTLAGIVALRSGLDPATARRIVDLILSVQRSGEMQAPPSMRTAILVARLAAPLRLAGRLSDAALAEIAADVLRGRGLEADAAAFEAKLAAPTPGETAR

SEQ ID NO: 358 - protein, 329 aa, Serratia sp ATCC 39006
MIKQNTVSQYTVDDDLVVPEASEHFVATSYVNDIIERALVYLRAGYPVHFAGPSGIGKTTLAFHLAALWGRPVTMLQGNEEFVSSDLTGKDIGYRKSSLVDNYIHSVLKTEEQMNRMWVDNRLTTACRNGDMLIYDEFNRSKAETNNVLLSVLSEGILNLPGLRGVGEGYLDVHPEFRAIFTSNPEEYAGTHKTQDALMDRMITINIGLVDRDTELQILHARSELELKEAAYIVDIIRELRGNEHETKHGLRAGIAIAHILHQQGIKPRYGDKLFHAICYDVLSMDAAKIQHAGRSIYREMVDGVIRKICPPIGSDTVKASTQKIKAVE

SEQ ID NO: 359 - protein, 364 aa, Stella vacuolate ATCC-43931
MSTEPAPVMPPSTDIEFGSQRPARPKPAEALAVGYRLSARPAAPSTLTLRPRADFVETDQVKDLTRRGLGFLRAGYPLHFRGPAGTGKTTLALHVAAQLGRPVIVITGDNELGTADLVGSQRGYHYRKVVDQFIHNVTKLEETANQRWTDHRLTTACREGYTLVYDEFTRSRPETHNVLLGVFEEKILFLPAEAREECYIRVHPDFRAIFTSNPQEYAGVHASQDALADRLATIDVDYPNRAMELAVASARTGLAEAEAARIIDLVRAFRASGDYQQTPTMRASLMIARVAAQEGLRISVDDPGFVQLCMDALESRIFSGARQEADARARHRVALLGLLATHCPSEAPVARVATVARAKRKSAS

SEQ ID NO: 360 - protein, 332 aa, Thiocapsa rosea strain DSM 235
MSAKPLQDASEVSALNNDNVQPEASDTFVCTPSVEALAERASAYLQAGYPVHLAGPAGTGKTTLAFHAAAKRGRPVKLIHGNDELGLADMVGQDNGYRRNTLVDNYIHSVVKTQEEVRTFWIDNRVTTACLNGETLIYDEFNRSRPEVNNIFLSILGEGILNLPNRRHQGAGYLEVHPEFRVIFTSNPEEYAGTHKTQDALMDRMITMKIGHYDRETEIRVTRAKSGLPPSEVAIVVDIVRELRGQSVNHHRPTLRACIAIARIMADRRISARSNNSFFRDICRDILDMDSAKVRRDGNALGESPVDDVVASISARARRPKIVEPKGLHKEI

SEQ ID NO: 361 - protein, 348 aa, Tolypothrix sp PCC 7601
MTNTENHKKRAVLRVRPGQFVVTPAIEKVAIRALRYLTSGFAIHLRGPAGTGKTTLAMHLANCLDRPIMLIFGDDEFKSSDLIGSESGYTHKKLLDNYIHNVLKVEDELKQNWVDSRLTLACREGLTLVYDEFNRSRPEVNNVLLSALEEKILTLPPSSNQPEYLHVHPKFRAIFTSNPEEYCGVHSTQDALMDRLVTINMPEPDEQTQIEILTHKTGIHHEYAQLIARLVKAFRSATGAEKTSGLRSCLMVAKVCAEHDILVTPENTDFREICADVLFNRTNLSASDATTLFLELLNHVQVKPVEPVDDSDPYDVAEAEIVGAAEPQTDAIAEPVTLDESLLSDQPN

SEQ ID NO: 362 - protein, 311 aa, Trichodesmium erythraeum IMS101
MTTVLNVSPDRFVSTPGVERVTQRASRYLESGYSVHLRGPAGVGKTTLALHLAHLRQQPIFLMIGDDEFKTSDLIGNKSGYTRKKLVDNYIHTVLKVEDELRDNWIDSRLTLACKEGFTLIYDEFNRSRPEVNNVLLSVLEEKMLVLPPSQNQSEYIQVHPQFRVILTSNSEEWTGVHATQDALLDRVVTIGMEQPDISTEQNIVIQKTGINPLKAEVIIKLVRSVRQRVDKEDLGSLRSALMISKVCHDHDIPLDGKDSSFSDLCADILISRPNLPRQEALQQLDEVLEEFFPADQPSSSDVGLEKEGSL

SEQ ID NO: 363 - protein, 311 aa, Trichodesmium erythraeum IMS101
MTTVLNVSPDRFVSTPSVERVTQRASRYLESGYSVHLRGPAGVGKTTLALHLAHLRQQPIFLMIGDDEFKTSDLIGNKSGYTRKKLVDNYIHTVLKVEDELKHNWIDSRLTLACKEGFTLIYDEFNRSRPEVNNVLLSVLEEKMLVLPPSQNQSEYIQVHPQFRVILTSNSEEWTGVHATQDALLDRVVTIGMGQPDISTEQNIIIQKTGINPLKAEVIIKLVRSVRERLETEDLGSLRSALMISKVCHDHDIPLGGKDSNFSDLCADILISRANLPRQEALKQLDEVLEELFPADQLSISDIGLKKEGSL

SEQ ID NO: 364 - protein, 114 aa, Anabaena-flos-aquae
MIKNIQVFFMKTISNRSISRAKISTMPRPKSDASSQLDLYKMVTEKQRIQRDMYSIKERMGLLQQRLDILNQQIEATEKTIHKLRQPHSNTAQNIVRSNIFVESNNYQTFEVEY

SEQ ID NO: 365 - protein, 105 aa, Aphanizomenon flos-aquae NIES-81
MKSFRHRSIIRAKISTMPRHISEASSQLELYKMVAEKQRISRELSSIKERMATLQKRLDSLNNEIDNTEKTIHKLRQPHSSTAQNIVRSKNVVESNNYQTFEIEY

SEQ ID NO: 366 - protein, 91 aa, Burkholderia thailandensis sp. Bp5365 strain MSMB43
MPIPKKGLHDIRFRHAPGATPLPVHSMYMRISCIEMEKSRRTIERRAAQRRIAAVDSRVADLEREKARLYAAIDNEAPQAGDIRGSFRIRY

SEQ ID NO: 367 - protein, 103 aa, Desulfobacterium vacuolatum DSM 3385
MLKNRNRSIKGVQNIKTHAGKVDHVSHPHMAYMRISCLEMEKARKNKEKSGAQKRIDMINQRLMEIEKEKAHIQRILGDTSIALESSNVDHDSEIKGGFKIKY

SEQ ID NO: 368 - protein, 106 aa, Desulfomonile tiedjei DSM 6799
MNIRMKGNSRGLRDIRTHSGKVDRVGLPYMAYMSISCLEMEKARREKERLSALTRIKNIEQRIREIEAEKDLLLKGVGERTRTDLQKASTPRDQSAQCKGGFKIRY

SEQ ID NO: 369 - protein, 105 aa, Legionella drancourtii LLAP12
MMPALVKGLRNIKTMSNRLDKVQSPHEAFISAAALHREKQRHLQELAILRNRLDEINLRLEQINEQQNQVAEAFDISPPRAVKSALRTGIQSKTGSTSHGFKIKY

SEQ ID NO: 370 - protein, 110 aa, Microcystis aeruginosa NIES-843
MTTTRPPRPIRSKISTMPRKQSEADHQLELYKLITEKQRIQEKLEMMERQIQQLKNRLTFVTEQIETTEQSIQNLRTANPPSVAKKPDSPKTVAHSSNNSSNFQTFYLEY

SEQ ID NO: 371 - protein, 94 aa, Nostoc punctiforme ATCC 29133
MHRTPNRRQIQAKLSTMPPQRSQATVYLNAYKMMLEKERLEEELEKLEARRHQIQQRLAILNSQTIPEENMTHQQANTDLENNTPKFNTLTLEY

SEQ ID NO: 372 - protein, 113 aa, Nostoc sp PCC 7120
MLSIIQVFPMTKVRNRGIIRPKITTMPRNKSEASSQLELYKLVTEQQRIKQELAFIEQRTVLLKQRLSTLKTQIEGTERSINHLRHSELKYSRIALPKIFSETNNYQAFDIEY

SEQ ID NO: 373 - protein, 108 aa, Planktothrix agardhii str. 7805
MRPFRSQPPILPKISTMPRQKTEATLYRSLYQLAVEKKRLQEELESLGQRFETVTQRLQQIETQIQGLETDVKQIAPPKPPETKPNQPSTPTPTKAEPGSVSTFTLDY

SEQ ID NO: 374 - protein, 103 aa, Psychromonas ingrahamii 37
MTAAKRKTLRGLADIRTISSCGTSGQEAYQMYLKRGVLEMEKLRRQKEKNSALERVTNINRRLMAIDTDIDFLCQSLKVIEKRTNQENSIVEKSVSRGFKLRY

SEQ ID NO: 375 - protein, 106 aa, Psychromonas ingrahamii 37
MIFSKKKNALRGLADIRTLSGCGTSGQEAYQMYLKRGVLEMEKLRRQKEKNSALERVRNINYRLMAIDADIDFLCQSLKVIEERTNKENSISNESVTYKKGFKLRY

SEQ ID NO: 376 - protein, 105 aa, Serratia sp ATCC 39006
MAISTRPLRTLSDIKTHSGRVSGEHQTYRDYFQIGALELERWRRTREREAASSRIASIDERIADIDKEKAALLADATAASAVAENNDKSEAAEKKKKSSGLRIKY

SEQ ID NO: 377 - protein, 130 aa, Thiocapsa rosea strain DSM 235
MSKFTQPSRSVRDIKTLAGMADDVRAPHKMYMRLFALETERHRRLQERASAMLRVDNIDARCAEIAEEMEQLLQILGVEAVAPGGPPANARPGSGRVPTQPHRGRGKGTGAGRQTTSGETSVGEAVKIRY

SEQ ID NO: 378 - protein, 226 aa, Anabaena-flos-aquae
MELENLYTYAFLEIPSSPLILPQGAANQVVLINGTELAAIVEPGIFLESFQNNDEKIIQMALSHDRVICELFQQITVLPLRFGTYFTSTNNLLNHLKSHEKEYQNKLEKINGKNEFTLKLIPRMIEEIVPSEGGGKDYFLAKKQRYQNQNNFSIAQAAEKQNLIDLITKVNQLPVVVQEQEEQIQIYLLVSCQDKTLLLEQFLTWQKACPRWDLLLGDCLPPYHFI

SEQ ID NO: 379 - protein, 226 aa, Aphanizomenon flos-aquae NIES-81
MELENLYTYAFLKTPSFSLHLPQGSTTSVIQIDGNGLSAIVEPGISLDSFQDDDEKIVQMAIEHDRVICDIFRQITVLPLRFGTYFANTDNLLTHLESYGQEYLDKLEKINCKTEFILKLIPRMITEESPVLESGRHYFLAKKQHYQRQKNFILAQASEKEILINFISKINQIPVIIQEQEEEVRIYLLVNYQDKTLLLEQFLTWQQTCPRWDLFLGEGIPPYHFI

SEQ ID NO: 380 - protein, 227 aa, Arthrospira platensis NIES-39
MYVYAFIKSQSISWKSVQGIYEPVVLLEAGALAAVVEPNLQAENLSADNEEELMRAVLTHDRIVCQIFEETTVLPVRFGTCFDSEARLCEHLTTEGDRYFRQLEKLTGRAEYLLEAIPQPFNQEKPSSDTTAPPTKGRDYFLQKKRLHQQRLNFEQQQEQQWQDFINAIASKYPIVQGKATEDAERIYLLIPRSQEVALVEWVAQQQQNIDLWEFSLGNAVPAYHFL

SEQ ID NO: 381 - protein, 226 aa, Dolichospermum circinale
MKLENFYTYAFLEIPRFPLVLPQGAASQVILINGSGMSAIVEPGISLESFQNNDEKIIQMALSHDRVICELFQQVTVLPLRFGTCFTSTNNLLNYLELHRQEYQEKLEKINGKIEFTLKLIPQTMEEPAPLERGGRDYFLAKKQRYQDQNNFRIAQAAEKQNLIDSISKVNQLPFVIQEKEEEVNIYLLVKSEDKTLLLEQFLNWQKACPRWDLLLGEPLPPYHFI

SEQ ID NO: 382 - protein, 227 aa, Microcystis aeruginosa NIES-843
MKLYNLYTYAFLKTPIESLKLPVGMANPLLLITGGELSAVVEPEVGLDTLQNDDERLIQSVLCHDRVICQLFQQTTILPLRFGTSFLEAENLLTHLCSHGQEYQEKIEELEGKGEYLLKCIPRKPEEPVLFSESKGRQYFLAKKQLYEAQQDFYTLQGSEWQNLVNLITQSYPSTRIITAPGTESRIYLLVNLQEEPLLIEQVLHWQKACPRWELQLGQVSPPYHFT

SEQ ID NO: 383 - protein, 229 aa, Nostoc punctiforme ATCC 29133
MSIYAYALLVPTASPLVLPLGMERNTELVYSSGLAALVEPEISLEAIQATDERLLQAVLNHDHVIRELFQQTPLLPLRFGRGFTSVEKLLNHLENHQEQYLETLTQLADKVEYSVKVTACSLLDDSDTIDARGKAYLLAKKQRYQTQQAFQAQQCEQWELLNELILKTYTNVICETRQSDVRQIHFLAQRNDSTLSTQLFSLWQVQCSHWQLALSEPLPPYHFLKNTLI

SEQ ID NO: 384 - protein, 227 aa, Nostoc sp PCC 7120
MRSPNFYTYAFLNTPDIPLRLPSGNLGQLLLIHGHKLSAVVEPGISLESSQNNDEEVIKMVLAHDRVICELSQQTTVLPLRFGTYFNSEETLLNHIESHAQEYQKKLDHIQGKTEYTLKLIPRKFEELAKVSGGNGRDYFLAKKLHYEHQKNFIGDQNREKNHLINLIMDVYRSSAIIQDYVEEVRLHLLVDRHDKTLLFKQVLTLQEKCPHWNLILGEPLPPYHFV

SEQ ID NO: 385 - protein, 88 aa, Bacillus-megaterium
MEIKKIMQAVNDFFGEHVAPPHKITSVEATEDEGWRVIVEVIEEREYMKKYAKDEMLGTYECFVNKEKEVISFKRLDVRYRSAIGIEA

SEQ ID NO: 386 - protein, 95 aa, Bacillus-megaterium
MSLKQSMENKDIALIDILDVILDKGVAIKGDLIISIAGVDLVYLDLRVLISSVETLVQAKEGNHKPITSEQFDKQKEELMDATGQPSKWTNPLGS

SEQ ID NO: 387 - protein, 65 aa, Rhodococcus hoagie 103S
MSATPDRRIALVDLLDRVLGGGVVVAGEITLSIADVDMVHISLRTLVSSVSALTRPPDEKPENDG

SEQ ID NO: 388 - protein, 292 aa, Bacillus-megaterium
MATETKLDNTQAENKENKNAENGSKEKNGSKASKTTSSGPIKRAVAGGIIGATIGYVSTPENRKSLLDRIDTDELKSKASDLGTKVKEKSKSSVASLKTSAGSLFKKDKDKSKDDEENVNSSSSETEDDNVQEYDELKEENQTLQDRLSQLEEKMNMLVELSLNKNQDEEAEDTDSDEEENDENDENDENEQDDENEEETSKPRKKDKKEAEEEESESDEDSEEEEEDSRSNKKNKKVKTEEEDEDESEEEKKEAKPKKSTAKKSKNTKAKKNTDEEDDEATSLSSEDDTTA

SEQ ID NO: 389 - protein, 138 aa, Bacillus-megaterium
MSTGPSFSTKDNTLEYFVKASNKHGFSLDISLNVNGAVISGTMISAKEYFDYLSETFEEGSEVAQALSEQFSLASEASESNGEAEAHFIHLKNTKIYCGDSKSTPSKGKIFWRGKIAEVDGFFLGKISDAKSTSKKSS

SEQ ID NO: 390 - protein, 193 aa, Anabaena flos-aquae
MISLMAKIRQEHQSIAEKVAELSLETREFLSVTTAKRQEQAEKQAQELQAFYKDLQETSQQFLSETAQARIAQAEKQAQELLAFHKELQETSQQFLSATAQARIAQAEKQAQELLAFYQEVRETSQQFLSATAQARIAQAEKQAQELLAFHKELQETSQQFLSATADARTAQAKEQKESLLKFRQDLFVSIFG

SEQ ID NO: 391 - protein, 382 aa, Halobacterium salinarum
MSVTDKRDEMSTARDKFAESQQEFESYADEFAADITAKQDDVSDLVDAITDFQAEMTNTTDAFHTYGDEFAAEVDHLRADIDAQRDVIREMQDAFEAYADIFATDIADKQDIGNLLAAIEALRTEMNSTHGAFEAYADDFAADVAALRDISDLVAAIDDFQEEFIAVQDAFDNYAGDFDAEIDQLHAAIADQHDSFDATADAFAEYRDEFYRIEVEALLEAINDFQQDIGDFRAEFETTEDAFVAFARDFYGHEITAEEGAAEAEAEPVEADADVEAEAEVSPDEAGGESAGTEEEETEPAEVETAAPEVEGSPADTADEAEDTEAEEETEEEAPEDMVQCRVCGEYYQAITEPHLQTHDMTIQEYRDEYGEDVPLRPDDKT

SEQ ID NO: 392 - protein, 381 aa, Halobacterium mediterranei
MSVKDKREKMTATREEFAEVQQAFAAYADEFAADVDDKRDVSELVDGIDTLRTEMNSTNDAFRAYSEEFAADVEHFHTSVADRRDAFDAYADIFATDVAEMQDVSDLLAAIDDLRAEMDETHEAFDAYADAFVTDVATLRDVSDLLTAISELQSEFVSVQGEFNGYASEFGADIDQFHAVVAEKRDGHKDVADAFLQYREEFHGVEVQSLLDNIAAFQREMGDYRKAFETTEEAFASFARDFYGQGAAPMATPLNNAAETAVTGTETEVDIPPIEDSVEPDGEDEDSKADDVEAEAEVETVEMEFGAEMDTEADEDVQSESVREDDQFLDDETPEDMVQCLVCGEYYQAITEPHLQTHDMTIKKYREEYGEDVPLRPDDKA

SEQ ID NO: 393 - protein, 162 aa, Microchaete diplosiphon
MTPLMIRIRQEHRGIAEEVTQLFKDTQEFLSVTTAQRQAQAKEQAENLHQFHKDLEKDTEEFLTDTAKERMAKAKQQAEDLFQFHKEMAENTQEFLSETAKERMAQAQEQARQLREFHQNLEQTTNEFLADTAKERMAQAQEQKQQLHQFRQDLFASIFGTF

SEQ ID NO: 394 - protein, 129 aa, Nostoc sp
MTALMVRIRQEHRSIAEEVTQLFRETHEFLSATTAHRQEQAKQQAQQLHQFHQNLEQTTHEFLTETTTQRVAQAEAQANFLHKFHQNLEQTTQEFLAETAKNRTEQAKAQSQYLQQFRKDLFASIFGTF

SEQ ID NO: 395 - protein, 88 aa, Bacillus megaterium; identical to SEQ ID NO: 84

SEQ ID NO: 396 - protein, 88 aa, Bacillus megaterium; identical to SEQ ID NO: 385

SEQ ID NO: 397 - protein, 308 aa, Bacillus megaterium; identical to SEQ ID NO: 11

SEQ ID NO: 398 - protein, 255 aa, Bacillus megaterium; identical to SEQ ID NO: 12

SEQ ID NO: 399 - protein, 88 aa, Bacillus megaterium
MLHKLVTAPINLVVKIGEKVQEEADKQLYDLPTIQQKLIQLQMMFELGEIPEEAFQEKEDELLMRYEIAKRREIEQWEELTQKRNEES

SEQ ID NO: 400 - protein, 269 aa, Bacillus megaterium; identical to SEQ ID NO: 306

SEQ ID NO: 401 - protein, 95 aa, Bacillus megaterium; identical to SEQ ID NO: 386

SEQ ID NO: 402 - protein, 94 aa, Bacillus megaterium; identical to SEQ ID NO: 270

SEQ ID NO: 403 - protein, 100 aa, Bacillus megaterium; identical to SEQ ID NO: 207

SEQ ID NO: 404 - protein, 292 aa, Bacillus megaterium; identical to SEQ ID NO: 388

SEQ ID NO: 405 - protein, 138 aa, Bacillus megaterium; identical to SEQ ID NO: 389

SEQ ID NO: 406 - protein, 72 aa, Serratia sp.; identical to SEQ ID NO: 95

SEQ ID NO: 407 - protein, 65 aa, Serratia sp.; identical to SEQ ID NO: 257

SEQ ID NO: 408 - protein, 65 aa, Serratia sp.; identical to SEQ ID NO: 257

SEQ ID NO: 409 - protein, 164 aa, Serratia sp.
MGCLTDGMAQLRKNIDDSHESRIAQQNARVSSVSAQIAGFSTTRARNAAQDARARATFVADNVRGVNRMLSDFCHTREVMSRQQSEERATFVTDMSKKTLALLDGFNAERKSMAERCAKERADFIANVANDVAAFLSASEKDRMAAHAVFFGMTLAKKKTSLAV

SEQ ID NO: 410 - protein, 329 aa, Serratia sp.; identical to SEQ ID NO: 358

SEQ ID NO: 411 - protein, 105 aa, Serratia sp.; identical to SEQ ID NO: 376

SEQ ID NO: 412 - protein, 273 aa, Serratia sp.; identical to SEQ ID NO: 140

SEQ ID NO: 413 - protein, 262 aa, Serratia sp.; identical to SEQ ID NO: 322

SEQ ID NO: 414 - protein, 222 aa, Serratia sp.; identical to SEQ ID NO: 168

SEQ ID NO: 415 - protein, 138 aa, Serratia sp.; identical to SEQ ID NO: 201

SEQ ID NO: 416 - protein, 637 aa, Serratia sp.
MKPAIYPKFLLESPLKLVFFGGKGGVGKSTCATSTALRLAQEQPQHHFLLVSTDPAHSLQNILSDLVLPKNLDVRELNAAASLHEFKSQHEGVLKEIAYRGTVLDQNDVQGLMDTALPGMDELAAYLEIAEWIQKDTYYRIIIDTAPTGHTLRLLEMPDLIYRWLTALDTLLAKQRYIRKRFAGDNRLDHLDHFLLDMNDSLKAMHELVTDSTRCCFVLVMLAEAMSVEESIDLAGALNQQRVFLSDLVVNRLFPENDCPTCCVERNRQMLALQNGYQRLPGHVFWTLPLLAIEPRGALLHEFWSGVRLLDENEVMATTCHHQLPLRVESSISLPASTFRLLIFAGKGGVGKTTLACATALRLNSEYPELRILLFSADPAHSLSDCLGVTLQQQPISVLVNIDAQEINAQADFDKIRQGYRAELEAFLLDTLPNLDITFDREVLEHLLDLAPPGLDEIMALTAIMDHLDSGRYDMVIVDGAPSGHLLRLLELPELIRDWLKQFFSLLLKYRKVMRFPHLSERLVQLSRELKNLRALLQDTKQTGLYAVTVPTHLALEKTYEMTCALQRLGLTANALFINQITPPSDCTLCQAITSRESLELKCADEMFPSQPHAQIFRQTEPTGLSKLKTLGSALFL

SEQ ID NO: 417 - protein, 115 aa, Serratia sp.; identical to SEQ ID NO: 298

SEQ ID NO: 418 - protein, 87 aa, Serratia sp.
MVNTTNDINAATRGLLLRMGNAWFEQDELRQAVDIYLKIIEQYPDSKESKTAQTALLTISQRYERDGLFRLSLDILERVGEITPTSI

SEQ ID NO: 419 - protein, 192 aa, Serratia sp.
MRALIHFPIIHSPKDLGTLSEAASHLRTETQTRAYLAAVEGFWTMITTTIEGLDLDYTHLKLYQDGLPVCGKENEIVTDVANAGSQNYKLLLTLQHKGAILMGTESPELLLQERDLMTQLLQSTEQTEASLETAKTLLNRRDDYIAQRIDETLQDGEMAILFLGLMHNIEAKLPADIVFIQPLGKPPGGESI

SEQ ID NO: 420 - protein, 160 aa, Serratia sp.
MTGNVEGILRGLGDLVEKLVETGEQIKRSGAFDIDTNDGKNAKAVYGFSIKMGLDGNQENRVEPFGNIRRDEQTGEATVQEVSEPLVDVIEESDHVLVLAEMPGVADEDVQVELNGDILTLHSERGSKKYHKEIVLPCSFDDKAMERSCRNGILEVKLGK

SEQ ID NO: 421 - protein, 720 aa, Serratia sp.
MSEELKLKVAEALPKDAGRGYARLDPADMARLNLAVGDIVQLTSKKGTGIAKLMPTYPDMRNKGIVQLDGLTRRNTSLSLDEKVQIEPASCKHATQIVLIPTTITPNQRDLDYIGSLLDGLPVQKGDLLRAHLFGSRSADFKVESTIPDGAVLIDPTTTLVIGKSNAVGNSSHSTQRLSYEDVGGLKNQVRRIREMIELPLRYPEVFERLGIDAPKGVLLSGPPGCGKTLIARIIAQETDAQFFTISGPEIVHKFYGESEAHLRKIFEEAGRKGPSIIFLDEIDSIAPHRDKVVGDVEKRIVAQLLALMDGLKNRGKVIVIAATNLPNAIDPALRRPGRFDREISIPIPDREGRREIIEIHSTGMPLNADVDLNVLADITHGFVGADLEALCREAAMSALRRLLPEIDFSSAELPYDRLAELTVMMDDFRAALCEVSPSAIRELFVDIPDVRWEDVGGLDDVRRRLIESVEWPIKYPELYEQAGVKPPKGLLLAGPPGVGKTLIAKAVANESGVNVISVKGPALMSRYVGDSEKGVRELFLKARQAAPCIIFLDEVDSVIPARNEGAIDSHVAERVLSQFLSEMDGLEELKGVFVMGATNRADLIDPAMLRPGRFDEIIELGLPDEDARRQILAVHLRNKPLGDNIHADDLAERCDGASGAELAAVCNRAALAALRRAIQQSEEAVLSPSTVGETPVALTVRIEQHDFAEVIAEMFGDDA

SEQ ID NO: 422 - protein, 71 aa, Anabaena flos-aquae; identical to SEQ ID NO: 34

SEQ ID NO: 423 - protein, 193 aa, Anabaena flos-aquae; identical to SEQ ID NO: 390

SEQ ID NO: 424 - protein, 335 aa, Anabaena flos-aquae; identical to SEQ ID NO: 326

SEQ ID NO: 425 - protein, 248 aa, Anabaena flos-aquae; identical to SEQ ID NO: 206

SEQ ID NO: 426 - protein, 155 aa, Anabaena flos-aquae; identical to SEQ ID NO: 269

SEQ ID NO: 427 - protein, 245 aa, Anabaena flos-aquae; identical to SEQ ID NO: 106

SEQ ID NO: 428 - protein, 119 aa, Anabaena flos-aquae; identical to SEQ ID NO: 172

SEQ ID NO: 429 - protein, 114 aa, Anabaena flos-aquae; identical to SEQ ID NO: 364

SEQ ID NO: 430 - protein, 226 aa, Anabaena flos-aquae
MELENLYTYAFLEIPSSPLILPQGAANQVVLINGTELAAIVEPGIFLESFQNNDEKIIQMALSHDRVICELFQQITVLPLRFGTYFTSTNNLLNHLKSHEKEYQNKLEKINGKNEFTLKLIPRMIEEIVPSEGGGKDYFLAKKQRYQNQNNFSIAQAAEKQNLIDLITKVNQLPVVVQEQEEQIQIYLLVSCQDKTLLLEQFLTWQKACPKWDLLLGDCLPPYHFI

SEQ ID NO: 431 - DNA, 267 bp, Bacillus megaterium
atgagcatccagaagtccaccaacagcagcagcctggccgaagtgatcgaccggatcctggacaagggcatcgtgatcgacgccttcgccagagtgtccgtcgtgggcatcgagatcctgaccatcgaggccagagtcgtgatcgccagcgtggacacctggctgagatatgccgaagccgtgggcctgctgcgggacgacgtggaagaaaatggcctgcccgagcggagcaacagctctgagggacagccccggttcagcatctga

SEQ ID NO: 432 - DNA, 927 bp, Bacillus megaterium
atgaccgtgctgaccgacaagcggaagaagggcagcggcgccttcatccaggacgacgagacaaaagaggtgctgagcagagccctgagctacctgaagtccggctacagcatccacttcaccggacctgccggcggaggcaagacatctctggctagagccctggccaagaaacggaagcggcccgtgatgctgatgcacggcaaccacgagctgaacaacaaggacctgatcggcgatttcaccggctacaccagcaagaaagtgatcgaccagtacgtgcggagcgtgtacaagaaagacgaacaggtgtccgagaactggcaggacggcagactgctggaagccgtgaagaatggctacaccctgatctacgacgagttcaccagaagcaagcccgctaccaacaacatcttcctgagcatcctggaagagggcgtgctgcccctgtacggcgtgaagatgaccgaccctttcgtgcgcgtgcaccccgacttcagagtgatcttcaccagcaaccccgccgagtatgccggcgtgtacgatacccaggacgccctgctggaccggctgatcaccatgttcatcgactacaaggacatcgaccgggaaaccgccatcctgaccgagaaaaccgacgtggaagaggacgaggcccggaccatcgtgaccctggtggccaacgtgcggaacagaagcggcgacgagaatagcagcggcctgagcctgagagccagcctgatgattgccaccctggccacccagcaggacatccctatcgatggcagcgacgaggacttccagaccctgtgcatcgacatcctgcaccaccccctgaccaagtgcctggacgaggaaaacgccaagagcaaggccgagaagatcattctggaagagtgcaagaacatcgacaccgaggaaaagtga

SEQ ID NO: 433 - DNA, 768 bp, Bacillus megaterium
atgagcgagacaaacgagacaggcatctacatcttcagcgccatccagaccgacaaggacgaggaattcggcgccgtggaagtggaagggaccaaggccgagacattcctgatccggtacaaggacgccgccatggtggccgccgaagtgcccatgaagatctaccaccccaaccggcagaacctgctgatgcaccagaatgccgtggccgccatcatggacaagaacgacaccgtgatccccatcagcttcggcaacgtgttcaagagcaaagaggacgtgaaggtgctgctggaaaacctgtacccccagttcgagaagctgttccccgccatcaagggaaagatcgaagtgggcctgaaagtgatcggcaagaaagagtggctggaaaagaaagtgaacgagaaccccgagctggaaaaagtgtccgccagcgtgaagggcaagagcgaggccgctggctactacgagagaatccagctgggcggcatggcccagaagatgttcaccagcctgcagaaagaagtgaaaaccgacgtgttcagccccctggaagaagccgccgaggccgccaaagccaatgagcctacaggcgagacaatgctgctgaacgccagcttcctgatcaacagagaggacgaggccaagttcgacgaaaaagtgaatgaggcccacgagaactggaaggataaggccgacttccactacagcggcccctggcccgcctacaacttcgtgaacatccggctgaaggtggaagagaagtga

SEQ ID NO: 434 - DNA, 267 bp, Bacillus megaterium
atgctgcacaagctcgtgaccgcccccatcaacctggtcgtgaagatcggcgagaaggtgcaggaagaggccgacaagcagctgtacgacctgcccaccatccagcagaagctgatccagctgcagatgatgttcgagctgggcgagatccccgaggaagccttccaggaaaaagaggacgagctgctgatgagatacgagatcgccaagcggcgcgagatcgagcagtgggaggaactgacccagaagcggaacgaggaaagctga

SEQ ID NO: 435 - DNA, 810 bp, Bacillus megaterium
atgggcgagctgctgtacctgtacggcctgatccccaccaaagaggccgctgccatcgagcccttcccattctacaagggcttcgacggcgagcacagcctgtaccctatcgccttcgaccaagtgaccgccgtggtgttcaagctggacgccgacacctacagcgagaaagtgatccaggaaaagatggaacaggacatgagctggctgcaggaaaaggccttccaccaccacgagacagtggccgccctgtacgaggaattcaccatcatccccctgaagttctgcaccatctataagggcgaggaatccctgcaggccgccatcgagatcaacaaagagaagatcgagaactccctgaccctgctgcagggcaacgaggaatggaacgtgaagatctactgcgacgacaccgagctgaagaagggcatcagcgagacaaacgagagcgtgaaggccaagaagcaggaaatcagccacctgagccccggcagacagttcttcgagaagaagaagattgaccagctgatcgagaaagagctggaactgcacaagaacaaagtgtgcgaggaaatccacgacaagctgattgagctgagcctgtacgactccgtgaagaagaactggtccaaggacgtgaccggcgctgccgaacagatggcctggaacagcgtgttcctgctgcccagcctgcagatcaccaagttcgtgaacgagatcgaggaactgcagcagcggctggaaaacaagggctggaagttcgaagtgaccggcccctggcctccctaccacttcagcagctttgcctga

SEQ ID NO: 436 - DNA, 285 bp, Bacillus megaterium
atgagcctgaagcagagcatggaaaacaaggatatcgccctgatcgacatcctggacgtgatcctggacaagggcgtggccatcaagggcgacctgatcatctctatcgccggcgtggacctggtgtacctggacctgagagtgctgatctccagcgtggaaaccctggtgcaggccaaagagggcaaccacaagcccatcaccagcgagcagttcgacaagcagaaagaggaactgatggacgccaccggccagcccagcaagtggacaaatcctctgggcagc

SEQ ID NO: 437 - DNA, 285 bp, Bacillus megaterium
atgcagcccgtgtcccaggccaacggcagaatccacctggatcccgatcaggccgaacagggactggcccagctcgtgatgaccgtgatcgagctgctgcggcagatcgtggaacggcacgccatgagaagagtggaaggcggcaccctgaccgacgagcagatcgagaatctgggaatcgccctgatgaacctggaagagaagatggacgagctgaaagaggtgttcggactggacgccgaggacctgaacatcgacctgggccctctgggcagcctgctgtga

SEQ ID NO: 438 - DNA, 303 bp, Bacillus megaterium
atggccgtggaacacaacatgcagagcagcaccatcgtggacgtgctggaaaagatcctggacaagggcgtcgtgatcgccggggacatcacagtgggaatcgccgacgtggaactgctgaccatcaagatccggctgatcgtggccagcgtggacaaggccaaagaaatcggcatggattggtgggagaacgacccctacctgagcagcaagggcgccaacaacaaggccctggaagaggaaaacaagatgctgcacgagcggctgaaaacactggaagagaagatcgagacaaagcgctga

SEQ ID NO: 439 - DNA, 417 bp, Bacillus megaterium
atgagcaccggccccagcttcagcaccaaggacaacaccctggaatacttcgtgaaggccagcaacaagcacggcttcagcctggacatcagcctgaacgtgaacggggccgtgatcagcggcaccatgatcagcgccaaagagtacttcgactacctgagcgagacattcgaagagggcagcgaggtggcccaggccctgtctgagcagtttagcctggccagcgaggcctccgagtctaatggcgaagccgaggcccacttcatccacctgaagaacaccaagatctactgcggcgacagcaagagcacccccagcaagggcaagatcttctggcgcggcaagatcgccgaggtggacggattcttcctgggaaagatcagcgacgccaagtccaccagcaagaagtccagctga

SEQ ID NO: 440 - DNA, 508 bp, Artificial sequence
  synthetic polynucleotide
cgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagct

SEQ ID NO: 441 - DNA, 135 bp, Artificial sequence
  synthetic polynucleotide
aacttgtttattgcagcttataatggttacaaataaagcaatagcatcacaaatttcacaaataaagcatttttttcactgcattctagttgtggtttgtccaaactcatcaatgtatcttatcatgtctggatc

SEQ ID NO: 442 - protein, 24 aa, Artificial sequence
  synthetic polypeptide
GAPGSGATNFSLLKQAGDVEENPG

SEQ ID NO: 443 - DNA, 6675 bp, Artificial sequence
  synthetic polynucleotide
cgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccggactctagcctaggcttttgcaaaaagctatttaggtgacactatagaaggtacgcctgcaggtaccgagctcggatccagtacccttcaccatgaccgtgctgaccgacaagcggaagaagggcagcggcgccttcatccaggacgacgagacaaaagaggtgctgagcagagccctgagctacctgaagtccggctacagcatccacttcaccggacctgccggcggaggcaagacatctctggctagagccctggccaagaaacggaagcggcccgtgatgctgatgcacggcaaccacgagctgaacaacaaggacctgatcggcgatttcaccggctacaccagcaaaaaggtgatcgaccagtacgtgcggagcgtgtacaagaaagacgaacaggtgtccgagaactggcaggacggcagactgctggaagccgtgaagaatggctacaccctgatctacgacgagttcaccagaagcaagcccgctaccaacaacatcttcctgagcatccttgaggagggcgtgctgcccctgtacggcgtgaagatgaccgaccctttcgtgcgcgtgcaccccgacttcagagtgatctttaccagcaaccccgccgagtatgccggcgtgtacgatacccaggacgccctgctggaccggctgatcaccatgttcatcgactacaaggacatcgaccgggaaaccgctatcctgaccgagaaaactgacgtggaagaagacgaggcccggaccatcgtgaccctggtggccaacgtgcggaacagaagcggcgacgagaatagcagcggcctgagcctgagagccagcctgatgattgccaccctggccacccagcaggacatccctatcgatggcagcgacgaggacttccagaccctgtgcatcgacatcctgcaccaccccctgaccaagtgcctggacgaagagaacgccaagagcaaggccgagaagatcattctcgaagagtgcaagaacatcgacaccgaggagaagggtgccccgggatctggcgcaacaaattttagtcttttaaagcaggcaggagacgtcgaggaaaaccctggacccgtgagcgagacaaacgagacaggcatctacatcttcagcgccatccagacagacaaggatgaggaattcggcgccgtggaagtggaagggaccaaggctgagacattcctgatccggtataaggacgccgccatggtggccgccgaagtgcccatgaagatctaccaccccaaccggcagaacctgctgatgcaccagaatgccgtggccgccatcatggacaagaacgacaccgtgatccccatcagcttcggcaacgtgttcaagagcaaagaggacgtgaaggtgctcctggaaaacctgtacccccagttcgagaagctgttccccgccatcaagggaaagatcgaagtgggcctgaaggtgatcggcaagaaagagtggctcgaaaagaaagtgaacgagaaccccgagctggaaaaagtgtccgccagcgtgaagggcaagagcgaggccgctggctactacgagagaatccagctgggcggcatggcccagaagatgttcacaagcctgcagaaagaagtgaaaaccgacgtgttcagccccctggaagaagccgccgaggccgccaaagccaatgagcctacaggcgaaacaatgctgctgaacgccagcttcctgatcaacagagaggatgaggccaagttcgacgagaaagtcaatgaggcccacgagaactggaaggataaggccgacttccactacagcggcccctggcccgcctacaacttcgtgaacatccggctgaaggtggaagagaagggggcacctggctcgggagcgaccaacttctcattactcaaacaagccggagacgttgaggagaatccaggccctgtgctgcacaagctcgtgaccgcccccatcaacctggtcgtgaagatcggcgagaaggtgcaggaagaggccgacaagcagctgtacgacctgcccaccatccagcagaagctgatccagctgcagatgatgttcgagctgggcgagatccccgaggaagccttccaggaaaaagaggacgaactgctgatgagatacgagatcgccaagcggcgcgagattgagcagtgggaagaactgacccagaagcggaatgaggaaagcggtgccccgggatctggcgcaacaaattttagtcttttaaagcaggcaggagacgtcgaggaaaaccctggacccgtgggcgagctgctgtacctctacggcctgatccccaccaaagaggccgctgctatcgagcccttcccattctacaagggcttcgacggcgagcacagcctgtaccctatcgccttcgaccaagtgaccgccgtggtgttcaagctggacgccgacacctacagcgagaaagtgatccaggaaaagatggaacaggacatgagctggctgcaggaaaaggccttccaccaccacgagacagtggccgccctgtatgaggaattcaccatcatccccctgaagttctgcaccatctataagggagaggaatccctgcaggccgccatcgagatcaacaaagagaagatcgaaaactccctgaccctgctgcagggcaacgaggaatggaacgtgaagatctactgcgacgacaccgagctgaagaagggcatcagcgagacaaacgagagcgtgaaggccaagaagcaggaaatcagccacctgagccccggcagacagttcttcgagaagaagaagattgaccagctcatcgagaaagagctggaactgcacaagaacaaagtgtgcgaggaaatccacgacaagctgattgagctgagcctctacgactccgtgaagaagaactggtccaaggacgtgacaggcgctgccgaacagatggcctggaacagcgtgttcctgctgcccagcctgcagatcaccaagttcgtgaacgagatcgaggaactccagcagcggctggagaacaagggatggaagttcgaagtgaccggcccctggcctccctaccacttcagcagctttgccggggcacctggctcgggagcgaccaacttctcattactcaaacaagccggagacgttgaggagaatccaggccctgtgagcctgaagcagagcatggagaataaggatatcgccctgatcgacatcctcgacgtgatcctggacaagggagtggccatcaagggcgacctgatcatctctatcgccggcgtggacctggtgtacctggatctgagagtgctgatctccagcgtggaaaccctggtgcaggccaaagagggcaaccacaagcccatcaccagcgagcagttcgacaagcagaaagaggagctgatggacgccaccggccagcccagcaagtggacaaatcctctgggcagcggcgctcccgggtcaggtgccacgaatttttcgttgttgaagcaagctggggatgttgaagagaacccagggcctgtgcagcccgtgtcccaggccaacggcagaatccacctggatcccgatcaggccgaacagggactggcccagctcgtgatgaccgtgatcgagctgctgcggcagatcgtggaacggcacgccatgagaagagtggaaggcggcaccctgaccgacgagcagatcgagaatctgggaatcgctctgatgaacctggaggagaagatggacgagctgaaagaggtgttcggactggacgctgaggatctgaacatcgacctgggccctctgggcagcctgctgggtgccccgggatctggcgcaacaaattttagtcttttaaagcaggcaggagacgtcgaggaaaaccctggacccgtggccgtggaacacaacatgcagagcagcaccatcgtggacgtgctggaaaagatcctggacaagggcgtcgtgatcgccggggacatcacagtgggaatcgccgacgtggaactgctgaccatcaagatccggctgatcgtggccagcgtggacaaggccaaagaaatcggcatggattggtgggagaacgacccctacctgagcagcaagggcgccaacaacaaggctctggaagaggaaaacaagatgctgcacgagcggctgaaaacactggaagagaagatcgagacaaagcgcggggcacctggctcgggagcgaccaacttctcattactcaaacaagccggagacgttgaggagaatccaggccctgtgagcaccggccccagcttcagcaccaaggacaacaccctggaatacttcgtgaaggccagcaacaagcacggctttagcctcgacatcagcctgaacgtgaatggggccgtgattagcggcaccatgatcagcgccaaagagtacttcgactacctgagcgagacattcgaagagggcagcgaagtggcccaggccctgtctgagcagtttagcctggctagcgaggcctccgagtctaatggcgaagccgaggcccacttcatccacctgaagaacaccaagatctactgcggcgacagcaagagcacccccagcaagggcaagatcttctggcgcggcaagatcgccgaggtggacggattcttcctgggaaaaatcagcgacgccaagtccaccagcaagaagtccagcggcgctcccgggtcaggtgccacgaatttttcgttgttgaagcaagctggggatgttgaagagaacccagggcctgtggtgtccaagggcgaggaactgttcaccggcgtggtgcccatcctggtggaactggatggcgacgtgaacggccacaagttcagcgtgtccggcgagggcgaaggcgacgccacatacggaaagctgaccctgaagttcatctgcaccaccggcaagctgcccgtgccttggcctaccctcgtgaccacactgacctacggcgtgcagtgcttcgccagataccccgaccacatgaagcagcacgatttcttcaagagcgccatgcccgagggctacgtgcaggaacggaccatcttcttcaaggacgacggcaactacaagacaagagccgaagtgaagttcgagggcgacaccctcgtgaaccggatcgagctgaagggcatcgacttcaaagaggatggcaacatcctgggccacaagctggagtacaactacaacagccacaaggtgtacatcaccgccgacaagcagaaaaacggcatcaaagtgaacttcaagacccggcacaacatcgaggacggcagcgtgcagctggccgaccactaccagcagaacacccccatcggagatggccccgtgctgctgcccgacaaccactacctgagcacacaaagcgccctgagcaaggaccccaacgagaagcgggaccacatggtgctgctggaatttgtgaccgccgctggcatcaccctgggcatggacgagctgtacaagtgactcgagtctagagggccccgtggctgtaatctagaggatccctcgaggggcccaagcttacgcgtgcatgcgacgtcatagctctctccctatagtgagtcgtattataagctagcttgggatctttgtgaaggaaccttacttctgtggtgtgacataattggacaaactacctacagagatttaaagctctaaggtaaatataaaatttttaagtgtataatgtgttaaactagctgcatatgcttgctgcttgagagttttgcttactgagtatgatttatgaaaatattatacacaggagctagtgattctaattgtttgtgtattttagattcacagtcccaaggctcatttcaggcccctcagtcctcacagtctgttcatgatcataatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctggatc

SEQ ID NO: 444 - DNA, 4009 bp, Artificial sequence
  synthetic polynucleotide
cgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccggactctagcctaggcttttgcaaaaagctatttaggtgacactatagaaggtacgcctgcaggtaccgagctcggatccagtacccttcaccatggccgtggaacacaacatgcagagcagcaccatcgtggacgtgctggaaaagatcctggacaagggcgtcgtgatcgccggggacatcacagtgggaatcgccgacgtggaactgctgaccatcaagatccggctgatcgtggccagcgtggacaaggccaaagaaatcggcatggattggtgggagaacgacccctacctgagcagcaagggcgccaacaacaaggccctggaagaggaaaacaagatgctgcacgagcggctgaaaacactggaagagaagatcgagacaaagcgcggtgccccgggatctggcgcaacaaattttagtcttttaaagcaggcaggagacgtcgaggaaaaccctggacccgtgagcgagacaaacgagacaggcatctacatcttcagcgccatccagacagacaaggatgaggaattcggcgccgtggaagtggaagggaccaaggctgagacattcctgatccggtataaggacgccgccatggtggccgccgaagtgcccatgaagatctaccaccccaaccggcagaacctgctgatgcaccagaatgccgtggccgccatcatggacaagaacgacaccgtgatccccatcagcttcggcaacgtgttcaagagcaaagaggacgtgaaggtgctcctggaaaacctgtacccccagttcgagaagctgttccccgccatcaagggaaagatcgaagtgggcctgaaggtgatcggcaagaaagagtggctcgaaaagaaagtgaacgagaaccccgagctggaaaaagtgtccgccagcgtgaagggcaagagcgaggccgctggctactacgagagaatccagctgggcggcatggcccagaagatgttcacaagcctgcagaaagaagtgaaaaccgacgtgttcagccccctggaagaagccgccgaggccgccaaagccaatgagcctacaggcgaaacaatgctgctgaacgccagcttcctgatcaacagagaggatgaggccaagttcgacgagaaagtcaatgaggcccacgagaactggaaggataaggccgacttccactacagcggcccctggcccgcctacaacttcgtgaacatccggctgaaggtggaagagaagggggcacctggctcgggagcgaccaacttctcattactcaaacaagccggagacgttgaggagaatccaggccctgtgctgcacaagctcgtgaccgcccccatcaacctggtcgtgaagatcggcgagaaggtgcaggaagaggccgacaagcagctgtacgacctgcccaccatccagcagaagctgatccagctgcagatgatgttcgagctgggcgagatccccgaggaagccttccaggaaaaagaggacgaactgctgatgagatacgagatcgccaagcggcgcgagattgagcagtgggaagaactgacccagaagcggaatgaggaaagcggtgccccgggatctggcgcaacaaattttagtcttttaaagcaggcaggagacgtcgaggaaaaccctggacccgtgggcgagctgctgtacctctacggcctgatccccaccaaagaggccgctgctatcgagcccttcccattctacaagggcttcgacggcgagcacagcctgtaccctatcgccttcgaccaagtgaccgccgtggtgttcaagctggacgccgacacctacagcgagaaagtgatccaggaaaagatggaacaggacatgagctggctgcaggaaaaggccttccaccaccacgagacagtggccgccctgtatgaggaattcaccatcatccccctgaagttctgcaccatctataagggagaggaatccctgcaggccgccatcgagatcaacaaagagaagatcgaaaactccctgaccctgctgcagggcaacgaggaatggaacgtgaagatctactgcgacgacaccgagctgaagaagggcatcagcgagacaaacgagagcgtgaaggccaagaagcaggaaatcagccacctgagccccggcagacagttcttcgagaagaagaagattgaccagctcatcgagaaagagctggaactgcacaagaacaaagtgtgcgaggaaatccacgacaagctgattgagctgagcctctacgactccgtgaagaagaactggtccaaggacgtgacaggcgctgccgaacagatggcctggaacagcgtgttcctgctgcccagcctgcagatcaccaagttcgtgaacgagatcgaggaactccagcagcggctggagaacaagggatggaagttcgaagtgaccggcccctggcctccctaccacttcagcagctttgccggggcacctggctcgggagcgaccaacttctcattactcaaacaagccggagacgttgaggagaatccaggccctgtgcagcccgtgtcccaggccaacggcagaatccacctggatcccgatcaggccgaacagggactggcccagctcgtgatgaccgtgatcgagctgctgcggcagatcgtggaacggcacgccatgagaagagtggaaggcggcaccctgaccgacgagcagatcgagaatctgggaatcgccctgatgaacctggaagagaagatggacgagctgaaagaggtgttcggactggacgccgaggacctgaacatcgacctgggccctctgggcagcctgctgtgataatctagaggatccctcgaggggcccaagcttacgcgtgcatgcgacgtcatagctctctccctatagtgagtcgtattataagctagcttgggatctttgtgaaggaaccttacttctgtggtgtgacataattggacaaactacctacagagatttaaagctctaaggtaaatataaaatttttaagtgtataatgtgttaaactagctgcatatgcttgctgcttgagagttttgcttactgagtatgatttatgaaaatattatacacaggagctagtgattctaattgtttgtgtattttagattcacagtcccaaggctcatttcaggcccctcagtcctcacagtctgttcatgatcataatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctggatc

SEQ ID NO: 445 - DNA, 3371 bp, Artificial sequence
  synthetic polynucleotide
ccctagaaagataatcatattgtgacgtacgttaaagataatcatgtgtaaaattgacgcatgtgttttatcggtctgtatatcgaggtttatttattaatttgaatagatattaagttttattatatttacacttacatactaataataaattcaacaaacaatttatttatgtttatttatttattaaaaaaaacaaaaactcaaaatttcttctataaagtaacaaaacttttatgagggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaggcctccacggccactagtttcactcgagtttactccctatcagtgatagagaacgtatgaagagtttactccctatcagtgatagagaacgtatgcagactttactccctatcagtgatagagaacgtataaggagtttactccctatcagtgatagagaacgtatgaccagtttactccctatcagtgatagagaacgtatctacagtttactccctatcagtgatagagaacgtatatccagtttactccctatcagtgatagagaacgtatgtcgaggtaggcgtgtacggtgggcgcctataaaagcagagctcgtttagtgaaccgtcagatcgcctggagcaattccacaacacttttgtcttatacttggtacctatgcatgccaccatgagcatccagaagtccaccaacagcagcagcctggccgaagtgatcgaccggatcctggacaagggcatcgtgatcgacgccttcgccagagtgtccgtcgtgggcatcgagatcctgaccatcgaggccagagtcgtgatcgccagcgtggacacctggctgagatatgccgaagccgtgggcctgctgcgggacgacgtggaagaaaatggcctgcccgagcggagcaacagctctgagggacagccccggttcagcatctgaactaaatcgcactgtcggcgtccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtgcacatgctttacatgtgtttagtcgaggttaaaaaacgtctaggccccccgaaccacggggacgtggttttcctttgaaaaacacgatgataatatggccacaaccatggtgagcaagggcgaggaggataacatggccatcatcaaggagttcatgcgcttcaaggtgcacatggagggctccgtgaacggccacgagttcgagatcgagggcgagggcgagggccgcccctacgagggcacccagaccgccaagctgaaggtgaccaagggcggccccctgcccttcgcctgggacatcctgtcccctcagttcatgtacggctccaaggcctacgtgaagcaccccgccgacatccccgactacttgaagctgtccttccccgagggcttcaagtgggagcgcgtgatgaacttcgaggacggcggcgtggtgaccgtgacccaggactcctccctgcaggacggcgagttcatctacaaggtgaagctgcgcggcaccaacttcccctccgacggccccgtaatgcagaagaagaccatgggctgggaggcctcctccgagcggatgtaccccgaggacggcgccctgaagggcgagatcaagcagaggctgaagctgaaggacggcggccactacgacgctgaggtcaagaccacctacaaggccaagaagcccgtgcagctgcccggcgcctacaacgtcaacatcaagttggacatcacctcccacaacgaggactacaccatcgtggaacagtacgaacgcgccgagggccgccactccaccggcggcatggacgagctgtacaagtgaactagttcgttaactaaacttgtttattgcagcttataatggttacaaataaagcaatagcatcacaaatttcacaaataaagcatttttttcactgcattctagttgtggtttgtccaaactcatcaatgtatcttatcatgtctggaattgactcaaatgatgtcaattagtctatcagaagctcatctggtctcccttccgggggacaagacatccctgtttaatatttaaacagcagtgttcccaaactgggttcttatatcccttgctctggtcaaccaggttgcagggtttcctgtcctcacaggaacgaagtccctaaagaaacagtggcagccaggtttagccccggaattgactggattccttttttagggcccattggtatggctttttccccgtatccccccaggtgtctgcaggctcaaagagcagcgagaagcgttcagaggaaagcgatcccgtgccaccttccccgtgcccgggctgtccccgcacgctgccggctcggggatgcggggggagcgccggaccggagcggagccccgggcggctcgctgctgccccctagcgggggagggacgtaattacatccctgggggctttgggggggggctgtccctgatatctataacaagaaaatatatatataataagttatcacgtaagtagaacatgaaataacaatataattatcgtatgagttaaatcttaaaagtcacgtaaaagataatcatgcgtcattttgactcacgcggtcgttatagttcaaaatcagtgacacttaccgcattgacaagcacgcctcacgggagctccaagcggcgactgagatgtcctaaatgcacagcgacggattcgcgctatttagaaagagagagcaatatttcaagaatgcatgcgtcaattttacgcagactatctttctaggg

SEQ ID NO: 446 - DNA, 7161 bp, Artificial sequence
  synthetic polynucleotide
ccctagaaagataatcatattgtgacgtacgttaaagataatcatgtgtaaaattgacgcatgtgttttatcggtctgtatatcgaggtttatttattaatttgaatagatattaagttttattatatttacacttacatactaataataaattcaacaaacaatttatttatgtttatttatttattaaaaaaaacaaaaactcaaaatttcttctataaagtaacaaaacttttatgagggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaggcctccacggccactagtttcactcgagtttactccctatcagtgatagagaacgtatgaagagtttactccctatcagtgatagagaacgtatgcagactttactccctatcagtgatagagaacgtataaggagtttactccctatcagtgatagagaacgtatgaccagtttactccctatcagtgatagagaacgtatctacagtttactccctatcagtgatagagaacgtatatccagtttactccctatcagtgatagagaacgtatgtcgaggtaggcgtgtacggtgggcgcctataaaagcagagctcgtttagtgaaccgtcagatcgcctggagcaattccacaacacttttgtcttatacttggtacctatgcatgccaccatgaccgtgctgaccgacaagcggaagaagggcagcggcgccttcatccaggacgacgagacaaaagaggtgctgagcagagccctgagctacctgaagtccggctacagcatccacttcaccggacctgccggcggaggcaagacatctctggctagagccctggccaagaaacggaagcggcccgtgatgctgatgcacggcaaccacgagctgaacaacaaggacctgatcggcgatttcaccggctacaccagcaaaaaggtgatcgaccagtacgtgcggagcgtgtacaagaaagacgaacaggtgtccgagaactggcaggacggcagactgctggaagccgtgaagaatggctacaccctgatctacgacgagttcaccagaagcaagcccgctaccaacaacatcttcctgagcatccttgaggagggcgtgctgcccctgtacggcgtgaagatgaccgaccctttcgtgcgcgtgcaccccgacttcagagtgatctttaccagcaaccccgccgagtatgccggcgtgtacgatacccaggacgccctgctggaccggctgatcaccatgttcatcgactacaaggacatcgaccgggaaaccgctatcctgaccgagaaaactgacgtggaagaagacgaggcccggaccatcgtgaccctggtggccaacgtgcggaacagaagcggcgacgagaatagcagcggcctgagcctgagagccagcctgatgattgccaccctggccacccagcaggacatccctatcgatggcagcgacgaggacttccagaccctgtgcatcgacatcctgcaccaccccctgaccaagtgcctggacgaagagaacgccaagagcaaggccgagaagatcattctcgaagagtgcaagaacatcgacaccgaggagaagggtgccccgggatctggcgcaacaaattttagtcttttaaagcaggcaggagacgtcgaggaaaaccctggacccgtgagcgagacaaacgagacaggcatctacatcttcagcgccatccagacagacaaggatgaggaattcggcgccgtggaagtggaagggaccaaggctgagacattcctgatccggtataaggacgccgccatggtggccgccgaagtgcccatgaagatctaccaccccaaccggcagaacctgctgatgcaccagaatgccgtggccgccatcatggacaagaacgacaccgtgatccccatcagcttcggcaacgtgttcaagagcaaagaggacgtgaaggtgctcctggaaaacctgtacccccagttcgagaagctgttccccgccatcaagggaaagatcgaagtgggcctgaaggtgatcggcaagaaagagtggctcgaaaagaaagtgaacgagaaccccgagctggaaaaagtgtccgccagcgtgaagggcaagagcgaggccgctggctactacgagagaatccagctgggcggcatggcccagaagatgttcacaagcctgcagaaagaagtgaaaaccgacgtgttcagccccctggaagaagccgccgaggccgccaaagccaatgagcctacaggcgaaacaatgctgctgaacgccagcttcctgatcaacagagaggatgaggccaagttcgacgagaaagtcaatgaggcccacgagaactggaaggataaggccgacttccactacagcggcccctggcccgcctacaacttcgtgaacatccggctgaaggtggaagagaagggggcacctggctcgggagcgaccaacttctcattactcaaacaagccggagacgttgaggagaatccaggccctgtgctgcacaagctcgtgaccgcccccatcaacctggtcgtgaagatcggcgagaaggtgcaggaagaggccgacaagcagctgtacgacctgcccaccatccagcagaagctgatccagctgcagatgatgttcgagctgggcgagatccccgaggaagccttccaggaaaaagaggacgaactgctgatgagatacgagatcgccaagcggcgcgagattgagcagtgggaagaactgacccagaagcggaatgaggaaagcggtgccccgggatctggcgcaacaaattttagtcttttaaagcaggcaggagacgtcgaggaaaaccctggacccgtgggcgagctgctgtacctctacggcctgatccccaccaaagaggccgctgctatcgagcccttcccattctacaagggcttcgacggcgagcacagcctgtaccctatcgccttcgaccaagtgaccgccgtggtgttcaagctggacgccgacacctacagcgagaaagtgatccaggaaaagatggaacaggacatgagctggctgcaggaaaaggccttccaccaccacgagacagtggccgccctgtatgaggaattcaccatcatccccctgaagttctgcaccatctataagggagaggaatccctgcaggccgccatcgagatcaacaaagagaagatcgaaaactccctgaccctgctgcagggcaacgaggaatggaacgtgaagatctactgcgacgacaccgagctgaagaagggcatcagcgagacaaacgagagcgtgaaggccaagaagcaggaaatcagccacctgagccccggcagacagttcttcgagaagaagaagattgaccagctcatcgagaaagagctggaactgcacaagaacaaagtgtgcgaggaaatccacgacaagctgattgagctgagcctctacgactccgtgaagaagaactggtccaaggacgtgacaggcgctgccgaacagatggcctggaacagcgtgttcctgctgcccagcctgcagatcaccaagttcgtgaacgagatcgaggaactccagcagcggctggagaacaagggatggaagttcgaagtgaccggcccctggcctccctaccacttcagcagctttgccggggcacctggctcgggagcgaccaacttctcattactcaaacaagccggagacgttgaggagaatccaggccctgtgagcctgaagcagagcatggagaataaggatatcgccctgatcgacatcctcgacgtgatcctggacaagggagtggccatcaagggcgacctgatcatctctatcgccggcgtggacctggtgtacctggatctgagagtgctgatctccagcgtggaaaccctggtgcaggccaaagagggcaaccacaagcccatcaccagcgagcagttcgacaagcagaaagaggagctgatggacgccaccggccagcccagcaagtggacaaatcctctgggcagcggcgctcccgggtcaggtgccacgaatttttcgttgttgaagcaagctggggatgttgaagagaacccagggcctgtgcagcccgtgtcccaggccaacggcagaatccacctggatcccgatcaggccgaacagggactggcccagctcgtgatgaccgtgatcgagctgctgcggcagatcgtggaacggcacgccatgagaagagtggaaggcggcaccctgaccgacgagcagatcgagaatctgggaatcgctctgatgaacctggaggagaagatggacgagctgaaagaggtgttcggactggacgctgaggatctgaacatcgacctgggccctctgggcagcctgctgggtgccccgggatctggcgcaacaaattttagtcttttaaagcaggcaggagacgtcgaggaaaaccctggacccgtggccgtggaacacaacatgcagagcagcaccatcgtggacgtgctggaaaagatcctggacaagggcgtcgtgatcgccggggacatcacagtgggaatcgccgacgtggaactgctgaccatcaagatccggctgatcgtggccagcgtggacaaggccaaagaaatcggcatggattggtgggagaacgacccctacctgagcagcaagggcgccaacaacaaggctctggaagaggaaaacaagatgctgcacgagcggctgaaaacactggaagagaagatcgagacaaagcgcggggcacctggctcgggagcgaccaacttctcattactcaaacaagccggagacgttgaggagaatccaggccctgtgagcaccggccccagcttcagcaccaaggacaacaccctggaatacttcgtgaaggccagcaacaagcacggctttagcctcgacatcagcctgaacgtgaatggggccgtgattagcggcaccatgatcagcgccaaagagtacttcgactacctgagcgagacattcgaagagggcagcgaagtggcccaggccctgtctgagcagtttagcctggctagcgaggcctccgagtctaatggcgaagccgaggcccacttcatccacctgaagaacaccaagatctactgcggcgacagcaagagcacccccagcaagggcaagatcttctggcgcggcaagatcgccgaggtggacggattcttcctgggaaaaatcagcgacgccaagtccaccagcaagaagtccagcggcgctcccgggtcaggtgccacgaatttttcgttgttgaagcaagctggggatgttgaagagaacccagggcctgtggtgtccaagggcgaggaactgttcaccggcgtggtgcccatcctggtggaactggatggcgacgtgaacggccacaagttcagcgtgtccggcgagggcgaaggcgacgccacatacggaaagctgaccctgaagttcatctgcaccaccggcaagctgcccgtgccttggcctaccctcgtgaccacactgacctacggcgtgcagtgcttcgccagataccccgaccacatgaagcagcacgatttcttcaagagcgccatgcccgagggctacgtgcaggaacggaccatcttcttcaaggacgacggcaactacaagacaagagccgaagtgaagttcgagggcgacaccctcgtgaaccggatcgagctgaagggcatcgacttcaaagaggatggcaacatcctgggccacaagctggagtacaactacaacagccacaaggtgtacatcaccgccgacaagcagaaaaacggcatcaaagtgaacttcaagacccggcacaacatcgaggacggcagcgtgcagctggccgaccactaccagcagaacacccccatcggagatggccccgtgctgctgcccgacaaccactacctgagcacacaaagcgccctgagcaaggaccccaacgagaagcgggaccacatggtgctgctggaatttgtgaccgccgctggcatcaccctgggcatggacgagctgtacaagtgaactagttcgttaactaaacttgtttattgcagcttataatggttacaaataaagcaatagcatcacaaatttcacaaataaagcatttttttcactgcattctagttgtggtttgtccaaactcatcaatgtatcttatcatgtctggaattgactcaaatgatgtcaattagtctatcagaagctcatctggtctcccttccgggggacaagacatccctgtttaatatttaaacagcagtgttcccaaactgggttcttatatcccttgctctggtcaaccaggttgcagggtttcctgtcctcacaggaacgaagtccctaaagaaacagtggcagccaggtttagccccggaattgactggattccttttttagggcccattggtatggctttttccccgtatccccccaggtgtctgcaggctcaaagagcagcgagaagcgttcagaggaaagcgatcccgtgccaccttccccgtgcccgggctgtccccgcacgctgccggctcggggatgcggggggagcgccggaccggagcggagccccgggcggctcgctgctgccccctagcgggggagggacgtaattacatccctgggggctttgggggggggctgtccctgatatctataacaagaaaatatatatataataagttatcacgtaagtagaacatgaaataacaatataattatcgtatgagttaaatcttaaaagtcacgtaaaagataatcatgcgtcattttgactcacgcggtcgttatagttcaaaatcagtgacacttaccgcattgacaagcacgcctcacgggagctccaagcggcgactgagatgtcctaaatgcacagcgacggattcgcgctatttagaaagagagagcaatatttcaagaatgcatgcgtcaattttacgcagactatctttctaggg

SEQ ID NO: 447 - DNA, 5617 bp, Artificial sequence
  synthetic polynucleotide
ccctagaaagataatcatattgtgacgtacgttaaagataatcatgtgtaaaattgacgcatgtgttttatcggtctgtatatcgaggtttatttattaatttgaatagatattaagttttattatatttacacttacatactaataataaattcaacaaacaatttatttatgtttatttatttattaaaaaaaacaaaaactcaaaatttcttctataaagtaacaaaacttttatgagggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaggcctccacggccactagttttccccgaaaagtgccacctgacgtcggcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtatggctgattatgatcctctagacatatgctgcagtcacttgtacagctcatccatgcccagggtgatgccagcggcggtccgaaattccagcagcaccatgtggtcccgcttctcgttggggtccttgctcagcacgctctgggtgctcaggtagtggctatcaggcagcagcacggggccatctccgatgggggtgttctgctggtagtggtcggccagctgcacgctgccatcttccacgttgtgccggatcttgaagttcactttgatgccgtttttctgcttcacggccatgatgtagatgttgtggctgttgaagttgtactccagcttgtggcccaggatgttgccgtcctctttgaagtccacgcccttcagctcgatccggttcacgagggtgtcgccctcgaacttcacttcggctctggtcttgtaggtgccgtcgtccttgaagaagatggtccgttcctgcacgtagccctcgggcatggcgctcttgaagaaatcgtgctgcttcatgtggtcggggtatctggcgaagcactgcacgccgtgagacagtgtggtcacgagggtaggccaaggcacgggcagcttgccggtggtgcagatgaacttcagggtcagcttgccatttgtggcgtcgccttcgccctctccccgcacagagaacttgtggccgttcacgtcgccatccagttccaccaggatgggcaccacgccggtgaacagttcctcgcccttggacaccatggtgaagggtactggatccgagctcggtacctgcaggcgtaccttctatagtgtcacctaaatgcgatctgacggttcactaaacgagctctgcttatataggcctcccaccgtacacgccacctcgacatactcgagtttactccctatcagtgatagagaacgtatgaagagtttactccctatcagtgatagagaacgtatgcagactttactccctatcagtgatagagaacgtataaggagtttactccctatcagtgatagagaacgtatgaccagtttactccctatcagtgatagagaacgtatctacagtttactccctatcagtgatagagaacgtatatccagtttactccctatcagtgatagagaacgtatgtcgaggtaggcgtgtacggtgggcgcctataaaagcagagctcgtttagtgaaccgtcagatcgcctggagcaattccacaacacttttgtcttatacttggtacctatgcatgccaccatggccgtggaacacaacatgcagagcagcaccatcgtggacgtgctggaaaagatcctggacaagggcgtcgtgatcgccggggacatcacagtgggaatcgccgacgtggaactgctgaccatcaagatccggctgatcgtggccagcgtggacaaggccaaagaaatcggcatggattggtgggagaacgacccctacctgagcagcaagggcgccaacaacaaggccctggaagaggaaaacaagatgctgcacgagcggctgaaaacactggaagagaagatcgagacaaagcgcggtgccccgggatctggcgcaacaaattttagtcttttaaagcaggcaggagacgtcgaggaaaaccctggacccgtgagcgagacaaacgagacaggcatctacatcttcagcgccatccagacagacaaggatgaggaattcggcgccgtggaagtggaagggaccaaggctgagacattcctgatccggtataaggacgccgccatggtggccgccgaagtgcccatgaagatctaccaccccaaccggcagaacctgctgatgcaccagaatgccgtggccgccatcatggacaagaacgacaccgtgatccccatcagcttcggcaacgtgttcaagagcaaagaggacgtgaaggtgctcctggaaaacctgtacccccagttcgagaagctgttccccgccatcaagggaaagatcgaagtgggcctgaaggtgatcggcaagaaagagtggctcgaaaagaaagtgaacgagaaccccgagctggaaaaagtgtccgccagcgtgaagggcaagagcgaggccgctggctactacgagagaatccagctgggcggcatggcccagaagatgttcacaagcctgcagaaagaagtgaaaaccgacgtgttcagccccctggaagaagccgccgaggccgccaaagccaatgagcctacaggcgaaacaatgctgctgaacgccagcttcctgatcaacagagaggatgaggccaagttcgacgagaaagtcaatgaggcccacgagaactggaaggataaggccgacttccactacagcggcccctggcccgcctacaacttcgtgaacatccggctgaaggtggaagagaagggggcacctggctcgggagcgaccaacttctcattactcaaacaagccggagacgttgaggagaatccaggccctgtgctgcacaagctcgtgaccgcccccatcaacctggtcgtgaagatcggcgagaaggtgcaggaagaggccgacaagcagctgtacgacctgcccaccatccagcagaagctgatccagctgcagatgatgttcgagctgggcgagatccccgaggaagccttccaggaaaaagaggacgaactgctgatgagatacgagatcgccaagcggcgcgagattgagcagtgggaagaactgacccagaagcggaatgaggaaagcggtgccccgggatctggcgcaacaaattttagtcttttaaagcaggcaggagacgtcgaggaaaaccctggacccgtgggcgagctgctgtacctctacggcctgatccccaccaaagaggccgctgctatcgagcccttcccattctacaagggcttcgacggcgagcacagcctgtaccctatcgccttcgaccaagtgaccgccgtggtgttcaagctggacgccgacacctacagcgagaaagtgatccaggaaaagatggaacaggacatgagctggctgcaggaaaaggccttccaccaccacgagacagtggccgccctgtatgaggaattcaccatcatccccctgaagttctgcaccatctataagggagaggaatccctgcaggccgccatcgagatcaacaaagagaagatcgaaaactccctgaccctgctgcagggcaacgaggaatggaacgtgaagatctactgcgacgacaccgagctgaagaagggcatcagcgagacaaacgagagcgtgaaggccaagaagcaggaaatcagccacctgagccccggcagacagttcttcgagaagaagaagattgaccagctcatcgagaaagagctggaactgcacaagaacaaagtgtgcgaggaaatccacgacaagctgattgagctgagcctctacgactccgtgaagaagaactggtccaaggacgtgacaggcgctgccgaacagatggcctggaacagcgtgttcctgctgcccagcctgcagatcaccaagttcgtgaacgagatcgaggaactccagcagcggctggagaacaagggatggaagttcgaagtgaccggcccctggcctccctaccacttcagcagctttgccggggcacctggctcgggagcgaccaacttctcattactcaaacaagccggagacgttgaggagaatccaggccctgtgcagcccgtgtcccaggccaacggcagaatccacctggatcccgatcaggccgaacagggactggcccagctcgtgatgaccgtgatcgagctgctgcggcagatcgtggaacggcacgccatgagaagagtggaaggcggcaccctgaccgacgagcagatcgagaatctgggaatcgccctgatgaacctggaagagaagatggacgagctgaaagaggtgttcggactggacgccgaggacctgaacatcgacctgggccctctgggcagcctgctgtgaactagttcgataccgtcgaccgttaactaaacttgtttattgcagcttataatggttacaaataaagcaatagcatcacaaatttcacaaataaagcatttttttcactgcattctagttgtggtttgtccaaactcatcaatgtatcttatcatgtctggaattgactcaaatgatgtcaattagtctatcagaagctcatctggtctcccttccgggggacaagacatccctgtttaatatttaaacagcagtgttcccaaactgggttcttatatcccttgctctggtcaaccaggttgcagggtttcctgtcctcacaggaacgaagtccctaaagaaacagtggcagccaggtttagccccggaattgactggattccttttttagggcccattggtatggctttttccccgtatccccccaggtgtctgcaggctcaaagagcagcgagaagcgttcagaggaaagcgatcccgtgccaccttccccgtgcccgggctgtccccgcacgctgccggctcggggatgcggggggagcgccggaccggagcggagccccgggcggctcgctgctgccccctagcgggggagggacgtaattacatccctgggggctttgggggggggctgtccctgatatctataacaagaaaatatatatataataagttatcacgtaagtagaacatgaaataacaatataattatcgtatgagttaaatcttaaaagtcacgtaaaagataatcatgcgtcattttgactcacgcggtcgttatagttcaaaatcagtgacacttaccgcattgacaagcacgcctcacgggagctccaagcggcgactgagatgtcctaaatgcacagcgacggattcgcgctatttagaaagagagagcaatatttcaagaatgcatgcgtcaattttacgcagactatctttctaggg

SEQ ID NO: 448 - DNA, 237 bp, Artificial sequence
  synthetic polynucleotide
ccctagaaagataatcatattgtgacgtacgttaaagataatcatgtgtaaaattgacgcatgtgttttatcggtctgtatatcgaggtttatttattaatttgaatagatattaagttttattatatttacacttacatactaataataaattcaacaaacaatttatttatgtttatttatttattaaaaaaaacaaaaactcaaaatttcttctataaagtaacaaaactttta

SEQ ID NO: 449 - DNA, 232 bp, Artificial sequence
  synthetic polynucleotide
gagggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaa

SEQ ID NO: 450 - DNA, 350 bp, Artificial sequence
  synthetic polynucleotide
gagtttactccctatcagtgatagagaacgtatgaagagtttactccctatcagtgatagagaacgtatgcagactttactccctatcagtgatagagaacgtataaggagtttactccctatcagtgatagagaacgtatgaccagtttactccctatcagtgatagagaacgtatctacagtttactccctatcagtgatagagaacgtatatccagtttactccctatcagtgatagagaacgtatgtcgaggtaggcgtgtacggtgggcgcctataaaagcagagctcgtttagtgaaccgtcagatcgcctggagcaattccacaacacttttgtcttatactt

SEQ ID NO: 451 - DNA, 122 bp, Artificial sequence
  synthetic polynucleotide
aacttgtttattgcagcttataatggttacaaataaagcaatagcatcacaaatttcacaaataaagcatttttttcactgcattctagttgtggtttgtccaaactcatcaatgtatctta

SEQ ID NO: 452 - DNA, 231 bp, Artificial sequence
  synthetic polynucleotide
ttttccccgtatccccccaggtgtctgcaggctcaaagagcagcgagaagcgttcagaggaaagcgatcccgtgccaccttccccgtgcccgggctgtccccgcacgctgccggctcggggatgcggggggagcgccggaccggagcggagccccgggcggctcgctgctgccccctagcgggggagggacgtaattacatccctgggggctttgggggggggctgtccct

SEQ ID NO: 453 - DNA, 309 bp, Artificial sequence
  synthetic polynucleotide
gatatctataacaagaaaatatatatataataagttatcacgtaagtagaacatgaaataacaatataattatcgtatgagttaaatcttaaaagtcacgtaaaagataatcatgcgtcattttgactcacgcggtcgttatagttcaaaatcagtgacacttaccgcattgacaagcacgcctcacgggagctccaagcggcgactgagatgtcctaaatgcacagcgacggattcgcgctatttagaaagagagagcaatatttcaagaatgcatgcgtcaattttacgcagactatctttctaggg

SEQ ID NO: 454 - DNA, 7535 bp, Artificial sequence
  synthetic polynucleotide
cgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccggactctagcctaggcttttgcaaaaagctatttaggtgacactatagaaggtacgcctgcaggtaccgagctcggatccagtacccttcaccatgagcatccagaagtccaccaacagcagcagcctggccgaagtgatcgaccggatcctggacaagggcatcgtgatcgacgccttcgccagagtgtccgtcgtgggcatcgagatcctgaccatcgaggccagagtcgtgatcgccagcgtggacacctggctgagatatgccgaagccgtgggcctgctgcgggacgacgtggaagaaaatggcctgcccgagcggagcaacagctctgagggacagccccggttcagcatctgaactaaatcgcactgtcggcgtccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtgcacatgctttacatgtgtttagtcgaggttaaaaaacgtctaggccccccgaaccacggggacgtggttttcctttgaaaaacacgatgataatatggccacaaccgtgaccgtgctgaccgacaagcggaagaagggcagcggcgccttcatccaggacgacgagacaaaagaggtgctgagcagagccctgagctacctgaagtccggctacagcatccacttcaccggacctgccggcggaggcaagacatctctggctagagccctggccaagaaacggaagcggcccgtgatgctgatgcacggcaaccacgagctgaacaacaaggacctgatcggcgatttcaccggctacaccagcaaaaaggtgatcgaccagtacgtgcggagcgtgtacaagaaagacgaacaggtgtccgagaactggcaggacggcagactgctggaagccgtgaagaatggctacaccctgatctacgacgagttcaccagaagcaagcccgctaccaacaacatcttcctgagcatccttgaggagggcgtgctgcccctgtacggcgtgaagatgaccgaccctttcgtgcgcgtgcaccccgacttcagagtgatctttaccagcaaccccgccgagtatgccggcgtgtacgatacccaggacgccctgctggaccggctgatcaccatgttcatcgactacaaggacatcgaccgggaaaccgctatcctgaccgagaaaactgacgtggaagaagacgaggcccggaccatcgtgaccctggtggccaacgtgcggaacagaagcggcgacgagaatagcagcggcctgagcctgagagccagcctgatgattgccaccctggccacccagcaggacatccctatcgatggcagcgacgaggacttccagaccctgtgcatcgacatcctgcaccaccccctgaccaagtgcctggacgaagagaacgccaagagcaaggccgagaagatcattctcgaagagtgcaagaacatcgacaccgaggagaagggtgccccgggatctggcgcaacaaattttagtcttttaaagcaggcaggagacgtcgaggaaaaccctggacccgtgagcgagacaaacgagacaggcatctacatcttcagcgccatccagacagacaaggatgaggaattcggcgccgtggaagtggaagggaccaaggctgagacattcctgatccggtataaggacgccgccatggtggccgccgaagtgcccatgaagatctaccaccccaaccggcagaacctgctgatgcaccagaatgccgtggccgccatcatggacaagaacgacaccgtgatccccatcagcttcggcaacgtgttcaagagcaaagaggacgtgaaggtgctcctggaaaacctgtacccccagttcgagaagctgttccccgccatcaagggaaagatcgaagtgggcctgaaggtgatcggcaagaaagagtggctcgaaaagaaagtgaacgagaaccccgagctggaaaaagtgtccgccagcgtgaagggcaagagcgaggccgctggctactacgagagaatccagctgggcggcatggcccagaagatgttcacaagcctgcagaaagaagtgaaaaccgacgtgttcagccccctggaagaagccgccgaggccgccaaagccaatgagcctacaggcgaaacaatgctgctgaacgccagcttcctgatcaacagagaggatgaggccaagttcgacgagaaagtcaatgaggcccacgagaactggaaggataaggccgacttccactacagcggcccctggcccgcctacaacttcgtgaacatccggctgaaggtggaagagaagggggcacctggctcgggagcgaccaacttctcattactcaaacaagccggagacgttgaggagaatccaggccctgtgctgcacaagctcgtgaccgcccccatcaacctggtcgtgaagatcggcgagaaggtgcaggaagaggccgacaagcagctgtacgacctgcccaccatccagcagaagctgatccagctgcagatgatgttcgagctgggcgagatccccgaggaagccttccaggaaaaagaggacgaactgctgatgagatacgagatcgccaagcggcgcgagattgagcagtgggaagaactgacccagaagcggaatgaggaaagcggtgccccgggatctggcgcaacaaattttagtcttttaaagcaggcaggagacgtcgaggaaaaccctggacccgtgggcgagctgctgtacctctacggcctgatccccaccaaagaggccgctgctatcgagcccttcccattctacaagggcttcgacggcgagcacagcctgtaccctatcgccttcgaccaagtgaccgccgtggtgttcaagctggacgccgacacctacagcgagaaagtgatccaggaaaagatggaacaggacatgagctggctgcaggaaaaggccttccaccaccacgagacagtggccgccctgtatgaggaattcaccatcatccccctgaagttctgcaccatctataagggagaggaatccctgcaggccgccatcgagatcaacaaagagaagatcgaaaactccctgaccctgctgcagggcaacgaggaatggaacgtgaagatctactgcgacgacaccgagctgaagaagggcatcagcgagacaaacgagagcgtgaaggccaagaagcaggaaatcagccacctgagccccggcagacagttcttcgagaagaagaagattgaccagctcatcgagaaagagctggaactgcacaagaacaaagtgtgcgaggaaatccacgacaagctgattgagctgagcctctacgactccgtgaagaagaactggtccaaggacgtgacaggcgctgccgaacagatggcctggaacagcgtgttcctgctgcccagcctgcagatcaccaagttcgtgaacgagatcgaggaactccagcagcggctggagaacaagggatggaagttcgaagtgaccggcccctggcctccctaccacttcagcagctttgccggggcacctggctcgggagcgaccaacttctcattactcaaacaagccggagacgttgaggagaatccaggccctgtgagcctgaagcagagcatggagaataaggatatcgccctgatcgacatcctcgacgtgatcctggacaagggagtggccatcaagggcgacctgatcatctctatcgccggcgtggacctggtgtacctggatctgagagtgctgatctccagcgtggaaaccctggtgcaggccaaagagggcaaccacaagcccatcaccagcgagcagttcgacaagcagaaagaggagctgatggacgccaccggccagcccagcaagtggacaaatcctctgggcagcggcgctcccgggtcaggtgccacgaatttttcgttgttgaagcaagctggggatgttgaagagaacccagggcctgtgcagcccgtgtcccaggccaacggcagaatccacctggatcccgatcaggccgaacagggactggcccagctcgtgatgaccgtgatcgagctgctgcggcagatcgtggaacggcacgccatgagaagagtggaaggcggcaccctgaccgacgagcagatcgagaatctgggaatcgctctgatgaacctggaggagaagatggacgagctgaaagaggtgttcggactggacgctgaggatctgaacatcgacctgggccctctgggcagcctgctgggtgccccgggatctggcgcaacaaattttagtcttttaaagcaggcaggagacgtcgaggaaaaccctggacccgtggccgtggaacacaacatgcagagcagcaccatcgtggacgtgctggaaaagatcctggacaagggcgtcgtgatcgccggggacatcacagtgggaatcgccgacgtggaactgctgaccatcaagatccggctgatcgtggccagcgtggacaaggccaaagaaatcggcatggattggtgggagaacgacccctacctgagcagcaagggcgccaacaacaaggctctggaagaggaaaacaagatgctgcacgagcggctgaaaacactggaagagaagatcgagacaaagcgcggggcacctggctcgggagcgaccaacttctcattactcaaacaagccggagacgttgaggagaatccaggccctgtgagcaccggccccagcttcagcaccaaggacaacaccctggaatacttcgtgaaggccagcaacaagcacggctttagcctcgacatcagcctgaacgtgaatggggccgtgattagcggcaccatgatcagcgccaaagagtacttcgactacctgagcgagacattcgaagagggcagcgaagtggcccaggccctgtctgagcagtttagcctggctagcgaggcctccgagtctaatggcgaagccgaggcccacttcatccacctgaagaacaccaagatctactgcggcgacagcaagagcacccccagcaagggcaagatcttctggcgcggcaagatcgccgaggtggacggattcttcctgggaaaaatcagcgacgccaagtccaccagcaagaagtccagcggcgctcccgggtcaggtgccacgaatttttcgttgttgaagcaagctggggatgttgaagagaacccagggcctgtggtgtccaagggcgaggaactgttcaccggcgtggtgcccatcctggtggaactggatggcgacgtgaacggccacaagttcagcgtgtccggcgagggcgaaggcgacgccacatacggaaagctgaccctgaagttcatctgcaccaccggcaagctgcccgtgccttggcctaccctcgtgaccacactgacctacggcgtgcagtgcttcgccagataccccgaccacatgaagcagcacgatttcttcaagagcgccatgcccgagggctacgtgcaggaacggaccatcttcttcaaggacgacggcaactacaagacaagagccgaagtgaagttcgagggcgacaccctcgtgaaccggatcgagctgaagggcatcgacttcaaagaggatggcaacatcctgggccacaagctggagtacaactacaacagccacaaggtgtacatcaccgccgacaagcagaaaaacggcatcaaagtgaacttcaagacccggcacaacatcgaggacggcagcgtgcagctggccgaccactaccagcagaacacccccatcggagatggccccgtgctgctgcccgacaaccactacctgagcacacaaagcgccctgagcaaggaccccaacgagaagcgggaccacatggtgctgctggaatttgtgaccgccgctggcatcaccctgggcatggacgagctgtacaagtgactcgagtctagagggccccgtggctgtaatctagaggatccctcgaggggcccaagcttacgcgtgcatgcgacgtcatagctctctccctatagtgagtcgtattataagctagcttgggatctttgtgaaggaaccttacttctgtggtgtgacataattggacaaactacctacagagatttaaagctctaaggtaaatataaaatttttaagtgtataatgtgttaaactagctgcatatgcttgctgcttgagagttttgcttactgagtatgatttatgaaaatattatacacaggagctagtgattctaattgtttgtgtattttagattcacagtcccaaggctcatttcaggcccctcagtcctcacagtctgttcatgatcataatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctggatc

SEQ ID NO: 455 - DNA, 4894 bp, Artificial sequence
  synthetic polynucleotide
cgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccggactctagcctaggcttttgcaaaaagctatttaggtgacactatagaaggtacgcctgcaggtaccgagctcggatccagtacccttcaccatgagcatccagaagtccaccaacagcagcagcctggccgaagtgatcgaccggatcctggacaagggcatcgtgatcgacgccttcgccagagtgtccgtcgtgggcatcgagatcctgaccatcgaggccagagtcgtgatcgccagcgtggacacctggctgagatatgccgaagccgtgggcctgctgcgggacgacgtggaagaaaatggcctgcccgagcggagcaacagctctgagggacagccccggttcagcatctgaactaaatcgcactgtcggcgtccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtgcacatgctttacatgtgtttagtcgaggttaaaaaacgtctaggccccccgaaccacggggacgtggttttcctttgaaaaacacgatgataatatggccacaaccgtggccgtggaacacaacatgcagagcagcaccatcgtggacgtgctggaaaagatcctggacaagggcgtcgtgatcgccggggacatcacagtgggaatcgccgacgtggaactgctgaccatcaagatccggctgatcgtggccagcgtggacaaggccaaagaaatcggcatggattggtgggagaacgacccctacctgagcagcaagggcgccaacaacaaggccctggaagaggaaaacaagatgctgcacgagcggctgaaaacactggaagagaagatcgagacaaagcgcggtgccccgggatctggcgcaacaaattttagtcttttaaagcaggcaggagacgtcgaggaaaaccctggacccgtgagcgagacaaacgagacaggcatctacatcttcagcgccatccagacagacaaggatgaggaattcggcgccgtggaagtggaagggaccaaggctgagacattcctgatccggtataaggacgccgccatggtggccgccgaagtgcccatgaagatctaccaccccaaccggcagaacctgctgatgcaccagaatgccgtggccgccatcatggacaagaacgacaccgtgatccccatcagcttcggcaacgtgttcaagagcaaagaggacgtgaaggtgctcctggaaaacctgtacccccagttcgagaagctgttccccgccatcaagggaaagatcgaagtgggcctgaaggtgatcggcaagaaagagtggctcgaaaagaaagtgaacgagaaccccgagctggaaaaagtgtccgccagcgtgaagggcaagagcgaggccgctggctactacgagagaatccagctgggcggcatggcccagaagatgttcacaagcctgcagaaagaagtgaaaaccgacgtgttcagccccctggaagaagccgccgaggccgccaaagccaatgagcctacaggcgaaacaatgctgctgaacgccagcttcctgatcaacagagaggatgaggccaagttcgacgagaaagtcaatgaggcccacgagaactggaaggataaggccgacttccactacagcggcccctggcccgcctacaacttcgtgaacatccggctgaaggtggaagagaagggggcacctggctcgggagcgaccaacttctcattactcaaacaagccggagacgttgaggagaatccaggccctgtgctgcacaagctcgtgaccgcccccatcaacctggtcgtgaagatcggcgagaaggtgcaggaagaggccgacaagcagctgtacgacctgcccaccatccagcagaagctgatccagctgcagatgatgttcgagctgggcgagatccccgaggaagccttccaggaaaaagaggacgaactgctgatgagatacgagatcgccaagcggcgcgagattgagcagtgggaagaactgacccagaagcggaatgaggaaagcggtgccccgggatctggcgcaacaaattttagtcttttaaagcaggcaggagacgtcgaggaaaaccctggacccgtgggcgagctgctgtacctctacggcctgatccccaccaaagaggccgctgctatcgagcccttcccattctacaagggcttcgacggcgagcacagcctgtaccctatcgccttcgaccaagtgaccgccgtggtgttcaagctggacgccgacacctacagcgagaaagtgatccaggaaaagatggaacaggacatgagctggctgcaggaaaaggccttccaccaccacgagacagtggccgccctgtatgaggaattcaccatcatccccctgaagttctgcaccatctataagggagaggaatccctgcaggccgccatcgagatcaacaaagagaagatcgaaaactccctgaccctgctgcagggcaacgaggaatggaacgtgaagatctactgcgacgacaccgagctgaagaagggcatcagcgagacaaacgagagcgtgaaggccaagaagcaggaaatcagccacctgagccccggcagacagttcttcgagaagaagaagattgaccagctcatcgagaaagagctggaactgcacaagaacaaagtgtgcgaggaaatccacgacaagctgattgagctgagcctctacgactccgtgaagaagaactggtccaaggacgtgacaggcgctgccgaacagatggcctggaacagcgtgttcctgctgcccagcctgcagatcaccaagttcgtgaacgagatcgaggaactccagcagcggctggagaacaagggatggaagttcgaagtgaccggcccctggcctccctaccacttcagcagctttgccggggcacctggctcgggagcgaccaacttctcattactcaaacaagccggagacgttgaggagaatccaggccctgtgcagcccgtgtcccaggccaacggcagaatccacctggatcccgatcaggccgaacagggactggcccagctcgtgatgaccgtgatcgagctgctgcggcagatcgtggaacggcacgccatgagaagagtggaaggcggcaccctgaccgacgagcagatcgagaatctgggaatcgccctgatgaacctggaagagaagatggacgagctgaaagaggtgttcggactggacgccgaggacctgaacatcgacctgggccctctgggcagcctgctgtgatcgagtctagagggccccgtggctgtaatctagaggatccctcgaggggcccaagcttacgcgtgcatgcgacgtcatagctctctccctatagtgagtcgtattataagctagcttgggatctttgtgaaggaaccttacttctgtggtgtgacataattggacaaactacctacagagatttaaagctctaaggtaaatataaaatttttaagtgtataatgtgttaaactagctgcatatgcttgctgcttgagagttttgcttactgagtatgatttatgaaaatattatacacaggagctagtgattctaattgtttgtgtattttagattcacagtcccaaggctcatttcaggcccctcagtcctcacagtctgttcatgatcataatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctggatc

SEQ ID NO: 456 - protein, 127 aa, Artificial Sequence
  synthetic polypeptide
MGSLTKLLLLPIMGPLNGVVWIAEQIQERTNTEFDAQENLHKQLLSLQLSFDIGEIGEEEFEIQEEEILLKIQALEEEARLELEAEQEEARLELEAEQEDFEYHLNSQQKLIKINISSCYLSIDGRK

SEQ ID NO: 457 - protein, 60 aa, Artificial Sequence
  synthetic polypeptide
MPVNKQYQDEQQQVSLCEALDRVLNKGVVIVADITISVANIDLIYLSLQALVSSVEAKNR

SEQ ID NO: 458 - protein, 61 aa, Artificial Sequence
  synthetic polypeptide
MSGNKKLTHSTDSTTVADLLERLLDKGVVISGDIRIRLVEVELLTLEIRLLICSVDKAVEM

SEQ ID NO: 459 - protein, 72 aa, Artificial Sequence
  synthetic polypeptide
MTVVPAQQTGGGGSSGLYDVLELVLDRGLVIDAFVRVSLVGIEILKIDVRVVVASVDTYLRFAEACNRLDLE

SEQ ID NO: 460 - protein, 72 aa, Artificial Sequence
  synthetic polypeptide
MITYDDEVVCAPRAGTLYDVLELILDRGMVIDVFVRVSLVGIEILKVDARIVVASVDTYLRFAEACNRLDLE

SEQ ID NO: 461 - protein, 72 aa, Artificial Sequence
  synthetic polypeptide
MTVSSQSMNRAPKPSSLADVLDVVLDRGIVIDAYARVALVGIEVLTADARVVIATVDTYLRFAEAVNRLDLA

SEQ ID NO: 462 - protein, 61 aa, Artificial Sequence
  synthetic polypeptide
MTINKSNDCSSLAEVVDRILDKGVVIDVFARISVIGIELITIEARIVIASVDTWLRYAEAV

SEQ ID NO: 463 - protein, 60 aa, Artificial Sequence
  synthetic polypeptide
MVSQSPDSSSLAEVLDRILDKGIVVDTWARVSLVGIEILAIEARVVVASVDTFLHYAEEI

SEQ ID NO: 464 - protein, 58 aa, Artificial Sequence
  synthetic polypeptide
MAQPDSSSLAEVLDRVLDKGVVVDVYARLSLVGIEILTVEARVVAASVDTFLHYAEEI

SEQ ID NO: 465 - protein, 58 aa, Artificial Sequence
  synthetic polypeptide
MVQPDSSSLAEVLDRVLDKGVVVDVWARISLVGIEILTVEARVVAASVDTFLHYAEEI

SEQ ID NO: 466 - protein, 58 aa, Artificial Sequence
  synthetic polypeptide
MAQPDSSGLAEVLDRVLDKGVVVDVWARVSLVGIEILTVEARVVAASVDTFLHYAEEI

SEQ ID NO: 467 - protein, 58 aa, Artificial Sequence
  synthetic polypeptide
MAQPDSSSLAEVLDRVLDKGVVVDVWARISLVGIEILTVEARVVAASVDTFLHYAEEI

SEQ ID NO: 468 - protein, 61 aa, Artificial Sequence
  synthetic polypeptide
MSIQKSTDSSSLAEVIDRILDKGIVIDAFARVSLVGIEILTIEARVVIASVDTWLRYAEAV

SEQ ID NO: 469 - protein, 61 aa, Artificial Sequence
  synthetic polypeptide
MSIQKSTNSSSLAEVIDRILDKGIVIDAFARVSVVGIEILTIEARVVIASVDTWLRYAEAV

SEQ ID NO: 470 - protein, 61 aa, Artificial Sequence
  synthetic polypeptide
MAVEKTNSSSSLAEVIDRILDKGIVIDAWVRVSLVGIELLAIEARIVIASVETYLKYAEAV

SEQ ID NO: 471 - protein, 61 aa, Artificial Sequence
  synthetic polypeptide
MAVEKTNSSSSLAEVIDRILDKGIVIDAWARVSLVGIELLAIEARVVIASVETYLKYAEAV

SEQ ID NO: 472 - protein, 62 aa, Artificial Sequence
  synthetic polypeptide
MAKVQKSTDSSSLAEVVDRILDKGIVIDAWVKVSLVGIELLSIEARVVIASVETYLKYAEAI

SEQ ID NO: 473 - protein, 112 aa, Arthrospira platensis NIES-39
MRYKYHRQIQPKLSAIPRQKSQANLYRNSYLLAVEKKRLTEELEVLQSRSHIIEQRLALIEDQLGELEKDVTQLSVPPSPKPQNNLPVNNPEPPPQSNPTNSSHINTFMVDY

SEQ ID NO: 474 - DNA, 12 bp, Artificial Sequence
  synthetic polynucleotide
  misc_feature (1)..(12): N7 N8 N9 can be TAG, TGA or TAA
nnnatgnnnnnn

SEQ ID NO: 475 - DNA, 9 bp, Artificial Sequence
  synthetic polynucleotide
gccaccatg

SEQ ID NO: 476 - DNA, 9 bp, Artificial Sequence
  synthetic polynucleotide
ttcaccatg

SEQ ID NO: 477 - DNA, 12 bp, Artificial Sequence
  synthetic polynucleotide
cccttcaccatg

SEQ ID NO: 478 - DNA, 9 bp, artificial sequence
  synthetic polynucleotide
  misc_feature (1)..(9): N1 can be any nucleic acid
  misc_feature (1)..(9): N2 can be any nucleic acid
  misc_feature (1)..(9): N3 can be any nucleic acid
  misc_feature (1)..(9): N4 can be A or G
  misc_feature (1)..(9): N5 can be any nucleic acid
  misc_feature (1)..(9): N6 can be any nucleic acid
nnnnnnatg

SEQ ID NO: 479 - DNA, 57 bp, Artificial Sequence
  synthetic polynucleotide
gctactaacttcagcctccttaaacaggccggcgacgtggaagagaatcctggctag

SEQ ID NO: 480 - DNA, 18 bp, Artificial Sequence
  synthetic polynucleotide
ggagcgccaggttccggg

The invention claimed is:

1. A Gas Vesicle Expression System (GVES) configured for expression, in a mammalian cell, of a gene cluster of gvp genes (GVGC) encoding GV proteins capable of forming a GV type, the Gas Vesicle Expression System comprising:
a GVPA/B gene expression cassette comprising a gvpA or a gvpB gene under control of a mammalian promoter and additional mammalian regulatory regions in a configuration allowing expression of the gvpA or gvpB protein in the mammalian cell; and
one or more additional gvp gene expression cassettes comprising the gvp genes of the GV gene cluster other than the gvpA and gvpB, under control of a mammalian promoter and additional regulatory regions in a configuration allowing expression of the GV proteins other than the gvpA and gvpB in the mammalian cell,
wherein each of the one or more additional gvp gene expression cassette, when comprising two or more gvp genes, further comprises a separation element between the two or more gvp genes configured to provide a separate expression of the corresponding GV protein; and
wherein the GVPA/B gene expression cassette and the one or more additional gvp gene expression cassettes are operably linked by regulatory sequences allowing co-expression of the GV proteins and formation of the GV type in the mammalian cell,
wherein the gas vesicle gene cluster comprises gvp genes from *B. megaterium* and/or *Anabaena flos-aquae*; the gas vesicle gene cluster comprising
gvpB, gvpN, gvpF, gvpG, gvpL, gvpS, gvpK, gvpJ, and gvpU from *B. megaterium*; or
gvpA, gvpC, gvpN, gvpJ, gvpK, gvpF, gvpG, gvpV, gvpW from *Anabaena flos-aquae*; or
gvpR, gvpN, gvpF, gvpG, gvpL, gvpS, gvpK, gvpJ, gvpT and gvpU from *B. megaterium* and gvpA gene from *Anabaena flos-aquae*; or
gvpA, and gvpC from *Anabaena flos-aquae*, and gvpN, gvpF, gvpG, gvpL, gvpS, gvpK, gvpJ, and gvpU from *B. megaterium*; or
gvpA, gvpC and gvpN from *Anabaena flos-aquae*, gvpF, gvpG, gvpL, gvpS, gvpK, gvpJ, and gvpU from *B. megaterium*.

2. The Gas Vesicle Expression System of claim 1, comprising the GVPA/B gene expression cassette and a single additional gvp gene expression cassette comprising the gvp genes of the GV gene cluster other than the gvpA and gvpB.

3. The Gas Vesicle Expression System of claim 1, wherein GVPA/B gene expression cassette and one or more additional gvp gene expression cassettes are within a same polynucleotide construct.

4. The Gas Vesicle Expression System of claim 1, wherein GVPA/B gene expression cassette and one or more additional gvp gene expression cassettes are on at least two separate polynucleotide constructs.

5. The Gas Vesicle Expression System of claim 4, wherein the one additional gvp gene expression cassette is a single additional gvp gene expression cassette on a Gas Vesicle Polynucleotide Construct (GVPC).

6. The Gas Vesicle Expression system of claim 1, wherein the gene cluster of gvp genes (GVGC) is a naturally occurring gas vesicle gene cluster, or an engineered gas vesicle gene cluster.

7. The Gas Vesicle Expression system of claim 1, wherein the gas vesicle gene cluster comprises gvpB, gvpN, gvpF, gvpG, gvpL, gvpS, gvpK, gvpJ, and gvpU from *B. megaterium*.

8. The Gas Vesicle Expression system of claim 1, wherein the gas vesicle gene cluster is gvpA, gvpC, gvpN, gvpJ, gvpK, gvpF, gvpG, gvpV, gvpW from *Anabaena flos-aquae*.

9. The Gas Vesicle Expression system of claim 1, wherein the gas vesicle gene cluster is a hybrid gas vesicle gene cluster comprising gvpR, gvpN, gvpF, gvpG, gvpL, gvpS, gvpK, gvpJ, gvpT and gvpU from *B. megaterium* and gvpA gene from *Anabaena flos-aquae*.

10. The Gas Vesicle Expression system of claim 1, wherein the gas vesicle gene cluster is a hybrid gas vesicle gene cluster comprising gvpA, and gvpC from *Anabaena flos-aquae*, and gvpN, gvpF, gvpG, gvpL, gvpS, gvpK, gvpJ, and gvpU from *B. megaterium*.

11. The Gas Vesicle Expression system of claim 1, wherein the gas vesicle gene cluster is a hybrid gas vesicle gene cluster comprising gvpA, gvpC and gvpN from *Anabaena flos-aquae*, gvpF, gvpG, gvpL, gvpS, gvpK, gvpJ, and gvpU from *B. megaterium*.

12. A composition comprising the Gas Vesicle expression system (GVES) of claim 1 herein together with a suitable vehicle.

13. A genetically engineered mammalian Gas Vesicle Reporting molecular component (GVRMC), the gas vesicle reporting molecular component comprising
the Gas Vesicle expression system (GVES) of claim 1 in which the mammalian regulatory regions comprise a gas vesicle reporting (GVR) target region configured to be activated and/or inhibited by a molecular component of a genetic circuit;
wherein the gvp genes and mammalian regulatory regions are in a configuration allowing expression of the gvp genes through activation and/or inhibition of the gas vesicle reporting (GVR) target region, when the genetic circuit operates according to the circuit design in the mammalian cell.

14. A genetically engineered gas vesicle reporting (GVR) genetic circuit (GVRGC) configured for expression in a mammalian cell in which molecular components are connected one to another in a mammalian cell in accordance with a circuit design by activating, inhibiting, binding or converting reactions to form a fully connected network of interacting components, the GVR genetic circuit comprises
a mammalian Gas Vesicle Reporting Molecular Component (GVRMC) of claim 13 in a configuration in which the GV proteins are expressed and a gas vesicle (GV) type is provided when the genetic circuit operates according to the circuit design.

15. A genetically engineered isolated mammalian cell comprising the Gas Vesicle expression system (GVES) of claim 1, configured for expression in the genetically engineered mammalian cell.

16. A genetically engineered non-human mammalian host comprising the Gas Vesicle expression system (GVES) of claim 1, configured for expression in a mammalian cell of the genetically engineered non-human mammalian host.

17. A method to express a Gas Vesicle in a mammalian cell, the method comprising
introducing into the mammalian cell a genetically engineered Gas Vesicle expression system (GVES) of claim 1, for a time and under condition to allow expression of the gvp genes and production of the Gas vesicle type in the mammalian cell.

18. A method to provide a gas vesicle in a mammalian host comprising
introducing into a cell of the mammalian host the genetically engineered Gas Vesicle expression system (GVES) of claim 1, the introducing performed for a time and under condition to allow expression of the GV proteins and the production of the Gas vesicle type in the mammalian cell.

19. A method to provide a genetically engineered mammalian cell comprising a GVR genetic circuit, the method comprising:
genetically engineering the mammalian cell to introduce into the mammalian cell one or more genetically engineered Gas Vesicle Reporting Molecular Components (GVRMC) of claim 13 comprising a gas vesicle reporting (GVR) target region configured to be activated and/or inhibited by a molecular component of the GVR genetic circuit, to provide a Gas Vesicle Reporting Genetic Circuit (GVRGC).

20. A method to image a biochemical event in a mammalian cell comprised in an imaging target site, the method comprising:
introducing into the mammalian cell a Gas Vesicle Reporting Molecular Component (GVRMC) of claim 13 to provide a GVR genetic circuit in which an expression of the GV type or an intracellular spatial translocation of the GV type occurs when the GVR genetic circuit operates according to the circuit design in response to the biochemical event,
the introducing performed for a time and under conditions allowing expression of the GV protein and production of the GV type or an intracellular spatial translocation of the GV type in response to the biochemical event; and
imaging the target site comprising the mammalian host by applying a magnetic field and/or ultrasound to obtain an MRI and/or an ultrasound image of the target site.

21. A method to label a target mammalian host, the method comprising:
introducing into the mammalian cell a Gas Vesicle Reporting Molecular Component (GVRMC) of claim 13 to provide a GVR genetic circuit in which an expression of the GV type or an intracellular spatial translocation of the GV type occurs when the GVR genetic circuit operates according to the circuit design in response to a trigger molecular component;
wherein, the introducing is performed under conditions resulting in presence of the trigger molecular component in the target mammalian host.

* * * * *